US007125698B2

(12) United States Patent
Glenn et al.

(10) Patent No.: US 7,125,698 B2
(45) Date of Patent: Oct. 24, 2006

(54) POLYNUCLEOTIDES, MATERIALS INCORPORATING THEM, AND METHODS FOR USING THEM

(76) Inventors: Matthew Glenn, 14 Waimarie Road, Whenuapai, Auckland (NZ); Ilkka J. Havukkala, 19 Liley Place, Remucra, Auckland (NZ); Mark Lubbers, 397 Ruahine Street, Palmerston North (NZ); James Dekker, 135 Russel Street, Palmerston North (NZ)

( * ) Notice: Subject to any disclaimer, the term of this patent is extended or adjusted under 35 U.S.C. 154(b) by 497 days.

(21) Appl. No.: 10/264,213

(22) Filed: Oct. 3, 2002

(65) Prior Publication Data

US 2004/0009490 A1 Jan. 15, 2004

Related U.S. Application Data

(63) Continuation-in-part of application No. 09/971,536, filed on Oct. 2, 2001, which is a continuation-in-part of application No. 09/634,238, filed on Aug. 8, 2000, now Pat. No. 6,544,772.

(60) Provisional application No. 60/152,032, filed on Sep. 1, 1999, provisional application No. 60/152,031, filed on Sep. 1, 1999, provisional application No. 60/147,853, filed on Aug. 9, 1999, provisional application No. 60/147,852, filed on Aug. 9, 1999.

(51) Int. Cl.
 *C12N 9/10* (2006.01)
(52) U.S. Cl. ............ 435/193; 435/183; 435/194; 426/534; 530/350
(58) Field of Classification Search ............ 435/193, 435/183, 194; 426/534; 530/350
See application file for complete search history.

(56) References Cited

U.S. PATENT DOCUMENTS

| 6,379,663 B1 | 4/2002 | Gill et al. |
| 6,476,209 B1 | 11/2002 | Glenn et al. |
| 6,544,772 B1 | 4/2003 | Glenn et al. |

FOREIGN PATENT DOCUMENTS

| WO | WO 01/77335 A2 | 10/2001 |
| WO | WO 02/44383 A1 | 8/2002 |

OTHER PUBLICATIONS

GenBank Accession No. L04938, submitted Jul. 14, 1993.*
Massa, R.B., EBI Dbfetch, Accession No. AJ617682, submitted Dec. 15, 2003.
Pastar, I., EBI Dbfetch, Accession No. AJ496666, submitted Oct. 5, 2003.
NCBI Database, Accession No. ZP_00046718, submitted Sep. 30, 2004.
Stentz, Régis, et al., "Molecular Cloning and Analysis of the *ptsHI* Operon in *Lactobacillus sake*", *Applied and Environmental Microbiology*, vol. 63, No. 6, pp. 2111-2116 (1997).
Luesink, Evert J., et al., "Molecular Characterization of the *Lactococcus lactis ptsHI* Operon and Analysis of the Regulatory Role of HPr", *Journal of Bacteriology*, vol. 181, No. 3, pp. 764-771 (1999).
Groisillier, Agnés, et al., "Comparison of partial malolactic enzyme gene sequences for phylogenetic analysis of some lactic acid bacteria species and relationships with the malic enzyme", *International Journal of Systematic Bacteriology*, vol. 49, pp. 1417-1428 (1999).
GenBank Accession No. AF098777, submitted Jun. 2, 1999.
Kunji, Edmund R.S., et al., "The proteolytic systems of lactic acid bacteria", *Antonie van Leeuwenhoek*, vol. 70, pp. 187-221 (1996).
Branny, Pavel, et al., "An operon encoding three glycolytic enzymes in *Laciobacillus delbrueckii* subsp. *bulgaricus*: glyceraldehyde-3-phosphate dehydrogenase, phosphoglycerate kinase and triosephosphate isomerase", *Microbiology*, vol. 144, pp. 905-914 (1998).
GenBank Accession No. AJ000339, submitted May 8, 1998.
Hidalgo, Elena, et al., "Molecular Cloning and DNA Sequencing of the *Escherichia coli* K-12 ald Gene Encoding Aldehyde Dehydrogenase", *Journal of Bacteriology*, vol. 173, No. 19, pp. 6118-6123 (1991).
GenBank Accession No. P33898, submitted Jul. 15, 1999.
Schmidt, G., et al., "Molecular characterisation of the dnaK operon of *Lactobacillus sakei* LTH681", *Systematic and Applied Microbiology*, vol. 22, No. 3, pp. 321-328 (1999).

* cited by examiner

*Primary Examiner*—Jennifer E. Graser
(74) *Attorney, Agent, or Firm*—Janet Sleath; Speckman Law Group PLLC

(57) ABSTRACT

Novel polynucleotides isolated from *Lactobacillus rhamnosus*, as well as oligonucleotide probes and primers, genetic constructs comprising the polynucleotides, biological materials, including plants, microorganisms and multicellular organisms incorporating the polynucleotides, polypeptides expressed by the polynucleotides, and methods for using the polynucleotides and polypeptides are disclosed.

12 Claims, No Drawings

POLYNUCLEOTIDES, MATERIALS INCORPORATING THEM, AND METHODS FOR USING THEM

CROSS-REFERENCE TO RELATED APPLICATIONS

This application is a continuation-in-part of U.S. patent application Ser. No. 09/971,536, filed Oct. 2, 2001, which is a continuation-in-part of U.S. patent application Ser. No. 09/634,238, filed Aug. 8, 2000 now U.S. Pat. No. 6,544,772, which claims priority to U.S. Provisional Patent Application 60/147,853, filed Aug. 9, 1999, U.S. Provisional Patent Application 60/147,852, filed Aug. 9, 1999, U.S. Provisional Patent Application 60/152,032, filed Sep. 1, 1999, and U.S. Provisional Patent Application 60/152,031, filed Sep. 1, 1999.

TECHNICAL FIELD OF THE INVENTION

This invention relates to polynucleotides isolated from lactic acid bacteria as well as to probes and primers specific to the polynucleotides; genetic constructs comprising the polynucleotides; biological materials, including plants, microorganisms and multicellular organisms, incorporating the polynucleotides; polypeptides expressed by the polynucleotides; and methods for using the polynucleotides and polypeptides.

REFERENCE TO SEQUENCE LISTING SUBMITTED ON COMPACT DISC

This application incorporates by reference in its entirety the Sequence Listing that is provided in duplicate on compact discs that accompany the application. Each CD contains the following file: 1043c3 SEQLIST.txt, having a date of creation of Oct. 3, 2002 and a file size of 659 KB.

BACKGROUND OF THE INVENTION

The present invention relates to polynucleotides isolated from a specific strain of lactic acid bacteria, namely *Lactobacillus rhamnosus* HN001 (*L. rhamnosus* HN001). Lactic acid bacteria, and their enzymes, are the major determinants of flavor and fermentation characteristics in fermented dairy products, such as cheese and yogurt. Flavors are produced through the action of bacteria and their enzymes on proteins, carbohydrates and lipids.

*Lactobacillus rhamnosus* strain HN001 are heterofermentative bacteria that are Gram positive, non-motile, non-spore forming, catalase negative, facultative anaerobic rods exhibiting an optimal growth temperature of 37±1° C. and an optimum pH of 6.0–6.5. Experimental studies demonstrated that dietary supplementation with *Lactobacillus rhamnosus* strain HN001 induced a sustained enhancement in several aspects of both natural and acquired immunity (See PCT International Publication No. WO 99/10476). In addition, *L. rhamnosus* HN001, and certain other Gram-positive bacteria can specifically and directly modulate human and animal health (See, for example, Tannock et al., *Applied Environ. Microbiol.* 66:2578–2588, 2000; Gill et al., *Brit. J. Nutrition* 83:167–176; Quan Shu et al., *Food and Chem. Toxicol.* 38:153–161, 2000; Quan Shu et al., *Intl. J. Food Microbiol.* 56:87–96, 2000; Quan Shu et al., *Intl. Dairy J.* 9:831–836, 1999; Prasad et al., *Intl. Dairy J.* 8:993–1002, 1998; Sanders and Huis in't Veld, *Antonie van Leeuwenhoek* 76:293–315, 1999; Salminen et al., 1998. In: Lactic Acid Bacteria, Salminen S and von Wright A (eds)., Marcel Dekker Inc, New York, Basel, Hong Kong, pp. 211–253; Delcour et al., *Antonie van Leeuwenhoek* 76:159–184, 1999; Blum et al., *Antonie van Leeuwenhoek* 76:199–205, 1999; Yasui et al., *Antonie van Leeuwenhoek* 76:383–389, 1999; Hirayama and Rafter, *Antonie van Leeuwenhoek* 76:391–394, 1999; Ouwehand, 1998. In: Lactic Acid Bacteria, Salminen S and von Wright A (eds)., Marcel Dekker Inc, New York, Basel, Hong Kong, pp. 139–159; Isolauri et al., S 1998. In: Lactic Acid Bacteria, Salminen S and von Wright A (eds)., Marcel Dekker Inc, New York, Basel, Hong Kong, pp. 255–268; Lichtenstein and Goldin, 1998. In: Lactic Acid Bacteria, Salminen S and von Wright A (eds)., Marcel Dekker Inc, New York, Basel, Hong Kong, pp. 269–277; El-Nezami and Ahokas, 1998. In: Lactic Acid Bacteria, Salminen S and von Wright A (eds)., Marcel Dekker Inc, New York, Basel, Hong Kong, pp. 359–367; Nousianen et al., 1998. In: Lactic Acid Bacteria, Salminen S and von Wright A (eds)., Marcel Dekker Inc, New York, Basel, Hong Kong, pp. 437–473; Meisel and Bockelmann, *Antonie van Leeuwenhoek* 76:207–215, 1999; Christensen et al., *Antonie van Leeuwenhoek* 76:217–246, 1999; Dunne et al., *Antonie van Leeuwenhoek* 76:279–292, 1999). Beneficial health effects attributed to these bacteria include the following:

Increased resistance to enteric pathogens and anti—infection activity, including treatment of rotavirus infection and infantile diarrhea—due to increases in antibody production caused by an adjuvant effect, increased resistance to pathogen colonization; alteration of intestinal conditions, such as pH; and the presence of specific antibacterial substances, such as bacteriocins and organic acids.

Aid in lactose digestion—due to lactose degradation by bacterial lactase enzymes (such as beta-galactosidase) that act in the small intestine.

Anti-cancer (in particular anti-colon cancer) and anti-mutagenesis activities—due to anti-mutagenic activity; alteration of procancerous enzymatic activity of colonic microbes; reduction of the carcinogenic enzymes azoreductase, beta-glucuronidase and nitroreductase in the gut and/or faeces; stimulation of immune function; positive influence on bile salt concentration; and antioxidant effects.

Liver cancer reduction—due to aflatoxin detoxification and inhibition of mould growth.

Reduction of small bowel bacterial overgrowth—due to antibacterial activity; and decrease in toxic metabolite production from overgrowth flora.

Immune system modulation and treatment of autoimmune disorders and allergies—due to enhancement of non-specific and antigen-specific defence against infection and tumors; enhanced mucosal immunity; adjuvant effect in antigen-specific immune responses; and regulation of Th1/Th2 cells and production of cytokines.

Treatment of allergic responses to foods—due to prevention of antigen translocation into blood stream and modulation of allergenic factors in food.

Reduction of blood lipids and prevention of heart disease—due to assimilation of cholesterol by bacteria; hydrolysis of bile salts; and antioxidative effects.

Antihypertensive effect—bacterial protease or peptidase action on milk peptides produces antihypertensive peptides. Cell wall components act as ACE inhibitors Prevention and treatment of urogenital infections—due to adhesion to urinary and vaginal tract cells resulting in competitive exclusion; and production of antibacterial substances (acids, hydrogen peroxide and biosurfactants).

Treatment of inflammatory bowel disorder and irritable bowel syndrome—due to immuno-modulation; increased resistance to pathogen colonization; alteration of intestinal conditions such as pH; production of specific antibacterial substances such as bacteriocins, organic acids and hydrogen peroxide and biosurfactants; and competitive exclusion.

Modulation of infective endocarditis—due to fibronectin receptor-mediated platelet aggregation associated with *Lactobacillus* sepsis.

Prevention and treatment of *Helicobacter pylori* infection—due to competitive colonization and antibacterial effect.

Prevention and treatment of hepatic encephalopathy—due to inhibition and/or exclusion of urease-producing gut flora.

Improved protein and carbohydrate utilisation and conversion—due to production of beneficial products by bacterial action on proteins and carbohydrates.

Other beneficial health effects associated with *L. rhamnosus* include: improved nutrition; regulation of colonocyte proliferation and differentiation; improved lignan and isoflavone metabolism; reduced mucosal permeability; detoxification of carcinogens and other harmful compounds; relief of constipation and diarrhea; and vitamin synthesis, in particular folate.

Peptidases are enzymes that break the peptide bonds linking the amino group of one amino acid with the carboxy group (acid group) of an adjacent amino acid in a peptide chain. The bonds are broken in a hydrolytic reaction. There is a large family of peptidase enzymes that are defined by their specificity for the particular peptides bonds that they cleave (Barrett A J, Rawlings N D and Woessner J F (Eds.) 1998. *Handbook of proteolytic enzymes*. Academic Press, London, UK). The two main families are exopeptidases and endopeptidases.

Exopeptidases cleave amino acids from the N- or C-terminus of a peptide chain, releasing free amino acids or short (di- and tri-) peptides. Different types of exopeptidases include:

Aminopeptidases—release a free amino acid from the N-terminus of a peptide chain;

dipeptidyl-peptidase (also known as dipeptidyl-aminopeptidases)—release a dipeptide from the N-terminus of a peptide chain;

tripeptidyl-peptidases (also known as tripeptidyl-aminopeptidases)—release a tripeptide from the N-terminus of a peptide chain);

carboxypeptidases—release a free amino acid from the C-terminus of a peptide chain;

peptidyl-dipeptidase—release a dipeptide from the C-terminus of a peptide chain;

dipeptidases—release two free amino acids from a dipeptide; and tripeptidases—release a free amino acid and a dipeptide from a tripeptide.

Peptidases are important enzymes in the process of cheese ripening and the development of cheese flavor. The hydrolysis of milk caseins in cheese results in textural changes and the development of cheese flavors. The raft of proteolytic enzymes that cause this hydrolysis come from the lactic acid bacteria that are bound up in the cheese—either starter cultures that grow up during the manufacture of the cheese, or adventitious and adjunct non-starter lactic acid bacteria that grow in the cheese as it ripens (Law and Haandrikman, *Int. Dairy J.* 7:1–11, 1997).

Many other enzymes can also influence dairy product flavor, and functional and textural characteristics, as well as influencing the fermentation characteristics of the bacteria, such as speed of growth, acid production and survival (Urbach, *Int. Dairy J.* 5:877–890, 1995; Johnson and Somkuti, *Biotech. Appl. Biochem.* 13:196–204, 1991; El Soda and Pandian, *J. Dairy Sci.* 74:2317–2335, 1991; Fox et al., In Cheese: chemistry, physics and microbiology. Volume 1, General aspects, $2^{nd}$ edition, P Fox (ed) Chapman and Hall, London; Christensen et al., *Antonie van Leeuwenhoek* 76:217–246, 1999; Stingle et al., *J. Bacteriol.* 20:6354–6360, 1999; Stingle et al., *Mol. Microbiol.* 32:1287–1295, 1999; Lemoine et al., *Appl. Environ. Microbiol.* 63:1512–3518, 1997). Enzymes influencing specific characteristics and/or functions include the following:

Lysis of cells. These enzymes are mostly cell wall hydrolases, including amidases; muramidases; lysozymes, including N-acetyl muramidase; muramidase; N-acetyl-glucosaminidase; and N-acetylmuramoyl-L-alanine amidase. DEAD-box helicase proteins also influence autolysis.

Carbohydrate utilization. Lactose, citrate and diacetyl metabolism, and alcohol metabolism are particularly important. The enzymes involved include beta-galactosidase, lactate dehydrogenase, citrate lyase, citrate permease, 2,3 butanediol dehydrogenase (acetoin reductase), acetolactate decarboxylase, acetolactate synthase, pyruvate decarboxylase, pyruvate formate lyase, diacetyl synthase, diacetyl reductase, alcohol decarboxylase, lactate dehydrogenase, pyruvate dehydrogenase, and aldehyde dehydrogenase.

Lipid degradation, modification or synthesis. Enzymes involved include lipases, esterases, phospholipases, serine hydrolases, desaturases, and linoleate isomerase.

Polysaccharide synthesis. Polysaccharides are important not only for potential immune enhancement and adhesion activity but are important for the texture of fermented dairy products. The enzymes involved are a series of glucosyl transferases, including beta-(1-3) glucosyl transferase, alpha-N acetylgalactosaminyl transferase, phosphogalactosyl transferase, alpha-glycosyl transferase, UDP-N-acetylglucosamine C4 epimerase and UDP-N-acetylglucosamine transferase.

Amino acid degradation. Enzymes include glutamate dehydrogenase, aminotransferases, amino acid decarboxylases, and enzymes involved in sulphur amino acid degradation including cystothione beta-lyase.

Sequencing of the genomes, or portions of the genomes, of numerous organisms, including humans, animals, microorganisms and various plant varieties, has been and is being carried out on a large scale. Polynucleotides identified using sequencing techniques may be partial or full-length genes, and may contain open reading frames, or portions of open reading frames, that encode polypeptides. Putative polypeptides may be identified based on polynucleotide sequences and further characterized. The sequencing data relating to polynucleotides thus represents valuable and useful information.

Polynucleotides and polypeptides may be analyzed for varying degrees of novelty by comparing identified sequences to sequences published in various public domain databases, such as EMBL. Newly identified polynucleotides and corresponding putative polypeptides may also be compared to polynucleotides and polypeptides contained in public domain information to ascertain homology to known polynucleotides and polypeptides. In this way, the degree of similarity, identity or homology of polynucleotides and polypeptides having an unknown function may b e determined relative to polynucleotides and polypeptides having known functions.

Information relating to the sequences of isolated polynucleotides may be used in a variety of ways. Specified polynucleotides having a particular sequence may be isolated, or synthesized, for use in in vivo or in vitro experimentation as probes or primers. Alternatively, collections of sequences of isolated polynucleotides may be stored using magnetic or optical storage medium and analyzed or manipulated using computer hardware and software, as well as other types of tools.

SUMMARY OF THE INVENTION

The present invention provides isolated polynucleotides comprising a sequence selected from the group consisting of: (a) sequences identified in the attached Sequence Listing as SEQ ID NOS: 1–121; (b) variants of those sequences; (c) extended sequences comprising the sequences set out in SEQ ID NOS: 1–121, and their variants; and (d) sequences comprising at least a specified number of contiguous residues of a sequence of SEQ ID NOS: 1–121 (x-mers). Oligonucleotide probes and primers corresponding to the sequences set out in SEQ ID NOS: 1–121, and their variants are also provided. All of these polynucleotides and oligonucleotide probes and primers are collectively referred to herein, as "polynucleotides of the present invention."

The polynucleotide sequences identified as SEQ ID NOS: 1–121 were derived from a microbial source, namely from fragmented genomic DNA of *Lactobacillus rhamnosus*, strain HN001, described in PCT International Publication No. WO 99/10476. *Lactobacillus rhamnosus* strain HN001 are heterofermentative bacteria that are Gram positive, non-motile, non-spore forming, catalase negative, facultative anaerobic rods exhibiting an optimal growth temperature of 37±1° C. and an optimum pH of 6.0–6.5. Experimental studies demonstrated that dietary supplementation with *Lactobacillus rhamnosus* strain HN001 induced a sustained enhancement in several aspects of both natural and acquired immunity. A biologically pure culture of *Lactobacillus rhamnosus* strain HN001 was deposited at the Australian Government Analytical Laboratories (AGAL), The New South Wales Regional Laboratory, 1 Suakin Street, Pymble, NSW 2073, Australia, as Deposit No. NM97/09514, dated 18 Aug. 1997.

Certain of the polynucleotide sequences disclosed herein are "partial" sequences in that they do not represent a full-length gene encoding a full-length polypeptide. Such partial sequences may be extended by analyzing and sequencing various DNA libraries using primers and/or probes and well-known hybridization and/or PCR techniques. The partial sequences disclosed herein may thus be extended until an open reading frame encoding a polypeptide, a full-length polynucleotide and/or gene capable of expressing a polypeptide, or another useful portion of the genome is identified. Such extended sequences, including full-length polynucleotides and genes, are described as "corresponding to" a sequence identified as one of the sequences of SEQ ID NOS: 1–121 or a variant thereof, or a portion of one of the sequences of SEQ ID NOS: 1–121 or a variant thereof, when the extended polynucleotide comprises an identified sequence or its variant, or an identified contiguous portion (x-mer) of one of the sequences of SEQ ID NOS: 1–121 or a variant thereof.

The polynucleotides identified as SEQ ID NOS: 1–121 were isolated from *Lactobacillus rhamnosus* genomic DNA clones and represent sequences that are present in the cells from which the DNA was prepared. The sequence information may be used to identify and isolate, or synthesize, DNA molecules such as promoters, DNA-binding elements, open reading frames or full-length genes, that then can be used as expressible or otherwise functional DNA in transgenic organisms. Similarly, RNA sequences, reverse sequences, complementary sequences, antisense sequences and the like, corresponding to the polynucleotides of the present invention, may be routinely ascertained and obtained using the polynucleotides identified as SEQ ID NOS: 1–121.

The present invention further provides isolated polypeptides encoded, or partially encoded, by the polynucleotides disclosed herein. In certain specific embodiments, the polypeptides of the present invention comprise a sequence selected from the group consisting of sequences identified as SEQ ID NO: 122–253, and variants thereof. Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

Genetic constructs comprising the inventive polynucleotides are also provided, together with transgenic host cells comprising such constructs and transgenic organisms, such as microbes, comprising such cells.

The present invention also contemplates methods for modulating the polynucleotide and/or polypeptide content and composition of an organism, such methods involving stably incorporating into the genome of the organism a genetic construct comprising a polynucleotide of the present invention. In one embodiment, the target organism is a microbe, preferably a microbe used in fermentation, more preferably a microbe of the genus *Lactobacillus*, and most preferably *Lactobacillus rhamnosus*, or other closely microbial related species used in the dairy industry. In a related aspect, methods for producing a microbe having an altered genotype and/or phenotype is provided, such methods comprising transforming a microbial cell with a genetic construct of the present invention to provide a transgenic cell, and cultivating the transgenic cell under conditions conducive to growth and multiplication. Organisms having an altered genotype or phenotype as a result of modulation of the level or content of a polynucleotide or polypeptide of the present invention compared to a wild-type organism, as well as components and progeny of such organisms, are contemplated by and encompassed within the present invention.

The isolated polynucleotides of the present invention may be usefully employed for the detection of lactic acid bacteria, preferably *L. rhamnosus*, in a sample material, using techniques well known in the art, such as polymerase chain reaction (PCR) and DNA hybridization, as detailed below.

The inventive polynucleotides and polypeptides may also be employed in methods for the selection and production of more effective probiotic bacteria; as "bioactive" (health-promoting) ingredients and health supplements for immune function enhancement; for reduction of blood lipids such as cholesterol; for production of bioactive material from genetically modified bacteria; as adjuvants; for wound healing; in vaccine development, particularly mucosal vaccines; as animal probiotics for improved animal health and productivity; in selection and production of genetically modified rumen microorganisms for improved animal nutrition and productivity, better flavor and improved milk composition; in methods for the selection and production of better natural food bacteria for improved flavor, faster flavor development, better fermentation characteristics, vitamin synthesis and improved textural characteristics; for the production of improved food bacteria through genetic modification; and for the identification of novel enzymes for the production of, for example, flavors or aroma concentrates.

The isolated polynucleotides of the present invention also have utility in genome mapping, in physical mapping, and in positional cloning of genes of more or less related microbes. Additionally, the polynucleotide sequences identified as SEQ ID NOS: 1–121, and their variants, may be used to design oligonucleotide probes and primers. Such oligonucleotide probes and primers have sequences that are substantially complementary to the polynucleotide of interest over a certain portion of the polynucleotide. Oligonucleotide probes designed using the polynucleotides of the present invention may be used to detect the presence and examine the expression patterns of genes in any organism having sufficiently similar DNA and RNA sequences in their cells, using techniques that are well known in the art, such as slot blot DNA hybridization techniques. Oligonucleotide primers designed using the polynucleotides of the present invention may be used for polymerase chain reaction (PCR) amplifications. Oligonucleotide probes and primers designed using the polynucleotides of the present invention may also be used in connection with various microarray technologies, including the microarray technology of Affymetrix (Santa Clara, Calif.).

The polynucleotides of the present invention may also be used to tag or identify an organism or derived material or product therefrom. Such tagging may be accomplished, for example, by stably introducing a non-disruptive non-functional heterologous polynucleotide identifier into an organism, the polynucleotide comprising at least a portion of a polynucleotide of the present invention.

The polynucleotides of the present invention may also be used as promoters, gene regulators, origins of DNA replication, secretion signals, cell wall or membrane anchors for genetic tools (such as expression or integration vectors).

All references cited herein, including patent references and non-patent publications, are hereby incorporated by reference in their entireties.

DETAILED DESCRIPTION

The polynucleotides disclosed herein were isolated by high throughput sequencing of DNA libraries from the lactic acid bacteria *Lactobacillus rhamnosus* as described in Example 1. Cell wall, cell surface and secreted components of lactic acid bacteria are known to mediate immune modulation, cell adhesion and antibacterial activities, resulting in many beneficial effects including: resistance to enteric pathogens; modulation of cancer, including colon cancer; anti-mutagenesis effects; reduction of small bowel bacterial overgrowth; modulation of auto-immune disorders; reduction in allergic disorders; modulation of urogenital infections, inflammatory bowel disorder, irritable bowel syndrome, *Helicobacter pylori* infection and hepatic encephalopathy; reduction of infection with pathogens; regulation of colonocyte proliferation and differentiation; reduction of mucosal permeability; and relief of constipation and diarrhea. These cell components include, but are not limited to, peptidoglycans, teichoic acids, lipoteichoic acids, polysaccharides, adhesion proteins, secreted proteins, surface layer or S-layer proteins, collagen binding proteins and other cell surface proteins, and antibacterial substances such as bacteriocins and organic acids produced by these bacteria. Polynucleotides involved in the synthesis of these proteins and in the synthesis, modification, regulation, transport, synthesis and/or accumulation of precursor molecules for these proteins can be used to modulate the immune effects, antibacterial, cell adhesion and competitive exclusion effects of the bacteria or of components that might be produced by these bacteria.

In order to function effectively as probiotic bacteria, *L. rhamnosus* HN001 must survive environmental stress conditions in the gastrointestinal tract, as well as commercial and industrial processes. Modification of particular polynucleotides or regulatory processes has been shown to be effective against a number of stresses including oxidative stress, pH, osmotic stress, dehydration, carbon starvation, phosphate starvation, nitrogen starvation, amino acid starvation, heat or cold shock and mutagenic stress. Polynucleotides involved in stress resistance often confer multistress resistance, i.e., when exposed to one stress, surviving cells are resistant to several non-related stresses. Bacterial genes and/or processes shown to be involved in multistress resistance include:

Intracellular phosphate pools—inorganic phosphate starvation leads to the induction of pho regulon genes, and is linked to the bacterial stringent response. Gene knockouts involving phosphate receptor genes appear to lead to multistress resistance.

Intracellular guanosine pools—purine biosynthesis and scavenger pathways involve the production of phosphate-guanosine compounds that act as signal molecules in the bacterial stringent response. Gene knockouts involving purine scavenger pathway genes appear to confer multistress resistance.

Osmoregulatory molecules—small choline-based molecules, such as glycine-betaine, and sugars, such as trehalose, are protective against osmotic shock and are rapidly imported and/or synthesized in response to increasing osmolarity.

Acid resistance—lactobacilli naturally acidify their environment through t he excretion of lactic acid, mainly through the cit operon genes responsible for citrate uptake and utilization.

Stress response genes—a number of genes appear to be induced or repressed by heat shock, cold shock, and increasing salt through the action of specific promoters.

The isolated polynucleotides of the present invention, and genetic constructs comprising such polynucleotides, may be employed to produce bacteria having desired phenotypes, including increased resistance to stress and improved fermentation properties.

Many enzymes are known to influence dairy product flavor, functional and textural characteristics as well as general fermentation characteristics such as speed of growth, acid production and survival. These enzymes include those involved in the metabolism of lipids, polysaccharides, amino acids and carbohydrates as well as those involved in the lysis of the bacterial cells.

The isolated polynucleotides and polypeptides of the present invention have demonstrated similarity to polynucleotides and/or polypeptides of known function. The identity and functions of the inventive polynucleotides based on such similarities are shown below in Table 1.

TABLE 1

| SEQ ID NO: DNA | SEQ ID NO: PROT | Category | Description |
|---|---|---|---|
| 1 | 122 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered viability in response to stress conditions. Altered metabolic properties or regulation of metabolic pathways. Altered probiotic attributes. | Homologue of purL, encoding a phosphoribosylformylglycinamidine (FGAM) synthetase (EC 6.3.5.3). PurL catalyzes the fourth step in the biosynthesis of purines. It is involved in resistance environmental stress conditions and the stringent response through the control of intracellular phosphate levels. Purines also play essential roles in many other cellular functions, including DNA replication, transcription, intra-and extra-cellular signaling, energy metabolism, and as coenzymes for many biochemical reactions. |
| 2 | 123 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered viability in response to stress conditions. Altered metabolic properties or regulation of metabolic pathways. Altered probiotic attributes. | Homologue of 5'-Phosphoribosyl-5-aminoimidazole (AIR) carboxylase (EC 4.1.1.21). AIR carboxylase is responsible for $CO_2$ fixation during purine biosynthesis. It catalyzes the carboxylation of AIR to 5'-phosphoribosyl-5-aminoimidazole-4-carboxylic acid, in the de novo biosynthesis of purine nucleotides. AIR carboxylase is composed of two nonidentical subunits, the catalytic subunit is encoded by the purE gene, while the $CO_2$-binding subunit is encoded by the purK gene. These two genes form an operon in which the termination codon of the purE gene overlapped the initiation codon of the purK gene. The purEK operon is regulated by the purR gene product, and a purR regulatory-protein-binding site related to the sequences found in other pur loci was identified in the purEK operon control region. It is involved in resistance environmental stress conditions and the stringent response through the control of intracellular phosphate levels. Purines also play essential roles in many other cellular functions, including DNA replication, transcription, intra- and extra-cellular signaling, energy metabolism, and as coenzymes for many biochemical reactions. |
| 3 | 124 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered viability in response to stress conditions. Altered amino acid metabolism. Altered metabolic properties or regulation of metabolic pathways. Altered probiotic attributes. | Homologue of amino acid antiporters gadC, Xasa and acsA. Amino acid antiporters are integral membrane proteins involved in the transport of amino acids into the cell and in extreme acid resistance. GadC is homologous to putative glutamate-gamma-aminobutyrate antiporters of *Escherichia coli* and *Shigella flexneri* and contains 12 putative membrane-spanning domains. It belongs to the amino acid-polyamine-organocation (APC) superfamily, and the Xasa family of transporters. It is involved in glutamate-dependent acid resistance and in antiport of glutamate and glutamate-gamma-aminobutyrate (GABA). The chloride-dependent expression is activated by gadR. GadC is involved in tolerance to environmental stress conditions such as high salt and low pH. |

TABLE 1-continued

| SEQ ID NO: DNA | SEQ ID NO: PROT | Category | Description |
|---|---|---|---|
| 4 | 125, 126 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. | Homologue of the B-subunit of phosphate-specific transporter (PstB). PstB is an ATP binding cassette (ABC) protein. Phosphate-specific transporters (Pst) in bacteria are involved in phosphate transport. Pst is a multisubunit system and belongs to the ABC superfamily of transporters. (TC# 3.A.1.7.1) (Novak et al., J Bacteriol. 181: 1126–1133, 1999). Utility as a controlled expression vector and in the control of intracellular phosphate levels important for resistance to environmental stress conditions and induction of the stringent response. |
| 5, 106 | 127, 230 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. | Homologue of PstA/PstC, which are the two hydrophobic subunits of a phosphate-specific transporter (PstB), an ATP binding cassette (ABC) protein. Phosphate specific transporter (Pst) in bacteria is involved in phosphate transport. Pst is a multisubunit system and belongs to the ABC superfamily of transporters. (TC# 3.A.1.7.1) (Novak et al., J. Bacteriol. 181: 1126–1133, 1999). Utility as a controlled expression vector and in the control of intracellular phosphate levels important for resistance to environmental stress conditions and induction of the stringent response. |
| 6–10 | 128, 130–133 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. | Homologue of a response regulator belonging to the family of 2-component signal transduction proteins phosphorylated by a specific sensor kinase (phoR). PhoR activates/represses Pho regulon gene transcription in response to phosphate starvation. The gene is involved in cell cycle control, polysaccharide synthesis and intestinal adhesion, also multistress resistance. It is part of a phosphate (PHO) regulon which is regulated by extracellular phosphate and consists of 20 phosphate-regulated promotors, 10 regulatory genes and 2 phosphate transport systems. Under conditions of phosphate limitation, the response regulator PhoB is phosphorylated by the histidine kinase PhoR and binds to promoters that share a consensus PHO box. Under conditions of phosphate excess, PhoR, Pst, and PhoU downregulate the PHO regulon (Novak et al., J. Bacteriol. 181: 1126–1133, 1999). Utility as a controlled expression vector and in the control of intracellular phosphate levels important for resistance to environmental stress conditions and induction of the stringent response. |

TABLE 1-continued

| SEQ ID NO: DNA | SEQ ID NO: PROT | Category | Description |
|---|---|---|---|
| 6 | 129 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Regulation of metabolic pathways. Altered metabolic properties or regulation of metabolic pathways. Altered probiotic attributes. | Homologue of the response regulator PnpR. PnpR is part of a two-component regulatory system, PnpR-PnpS, and a downstream ABC transporter, similar to the Pst system in E. coli, including a gene encoding a PhoU protein. The E. coli Pst system belongs to the superfamily of ABC transporters. It is part of a phosphate (PHO) regulon which is regulated by extracellular phosphate and consists of 20 phosphate-regulated promotors, 10 regulatory genes and 2 phosphate transport systems. Under conditions of phosphate limitation, the response regulator PhoB is phosphorylated by the histidine kinase PhoR and binds to promoters that share a consensus PHO box. Under conditions of phosphate excess, PhoR, Pst, and PhoU downregulate the PHO regulon (Novak et al., J. Bacteriol. 181: 1126–1133, 1999). Utility in immune modulation, gut adhesion, cell wall synthesis and polysaccharide production, survival, controlled expression vector. |
| 11 | 134 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Regulation of metabolic pathways. Altered metabolic properties or regulation of metabolic pathways. Altered probiotic attributes. | Homologue of the histidine kinase PhoR, which is involved in the E. coli Pst system. PhoR is part of a phosphate (PHO) regulon and phosphorylates under conditions of phosphate limitation the response regulator PhoB. Under conditions of phosphate excess, PhoR, Pst, and PhoU down regulate the PHO regulon (Novak et al., J. Bacteriol. 181: 1126–1133, 1999) which consists of 20 phosphate-regulated promoters, 10 regulatory genes and 2 phosphate transport systems. Utility in immune modulation, gut adhesion, cell wall synthesis and polysaccharide production, survival, controlled expression vector. |
| 12, 107 | 135, 231 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Regulation of metabolic pathways. Altered metabolic properties or regulation of metabolic pathways. Altered probiotic attributes. | Homologue of PnpS (which in turn is a homologue of PhoR), which is part of a two-component regulatory system, PnpR-PnpS, and a downstream ATP-binding cassette (ABC) transporter, similar to the Pst system in E. coli including a gene encoding a PhoU protein. The E. coli Pst system belongs to the superfamily of ABC transporters. It is part of a phosphate (PHO) regulon which is regulated by extracellular phosphate and consists of 20 phosphate-regulated promoters, 10 regulatory genes and 2 phosphate transport systems. Under conditions of phosphate limitation, the response regulator PhoB is phosphorylated by the histidine kinase PhoR and binds to promoters that share a consensus PHO box. Under conditions of phosphate excess, PhoR, Pst, and PhoU downregulate the PHO regulon. PnpS (Novak et al., J. Bacteriol. 181: 1126–1133, 1999). Utility in immune modulation, gut adhesion, cell wall synthesis and polysaccharide production, survival, controlled expression vector. |

TABLE 1-continued

| SEQ ID NO: DNA | SEQ ID NO: PROT | Category | Description |
|---|---|---|---|
| 13, 14 | 136, 137 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of penicillin-binding protein 1B (Pbp1b) or murein polymerase. Penicillin-binding proteins (PBPs), targets of beta-lactam antibiotics, are membrane-bound enzymes essential for the biosynthesis of the bacterial cell wall. PBPs possess a penicillin-insensitive transglycosylase N-terminal domain (formation of linear glycan strands) and a penicillin-sensitive transpeptidase C-terminal domain (cross-linking of the peptide subunits) responsible for the final steps of the bacterial cell wall polymerization and cross-linking, respectively (Zhao et al., Protein Expr. Purif. 16: 331–339, 1999). Utility in immune modulation, gut adhesion, cell wall synthesis and polysaccharide production. |
| 15, 42, 108 | 138, 167, 232 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of penicillin-binding protein 5 (Pbp5) also known as muramoylpentapeptide carboxypeptidase (EC 3.4.17.8, formerly EC 3.4.12.6). Pbp5 is a bacterial enzyme that requires a divalent cation for activity. Does not cleave the C-terminal D-alanine from the reaction product, UDP-N-acetyl-muramoyl-L-alanyl-D-g-glutamyl-6-carboxy-L-lysyl-D-alanine. Competitively inhibited by penicillins and cephalosporins. Penicillin-binding proteins (PBPs), targets of beta-lactam antibiotics, are membrane-bound enzymes essential for the biosynthesis of the bacterial cell wall. (Sifaoui et al., Antimicrob. Agents Chemother. 45: 2594–2597, 2001). Utility in immune modulation, gut adhesion, cell wall synthesis and polysaccharide production. |
| 16, 109 | 139, 233 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. | Homologue of the hydrophobic transmembrane protein psaC. PsaC is a member of the of ABC superfamily, involved in the transport of nutrients, translocation of signal molecules and chemotaxis (Janulczyk et al., Mol. Microbiol. 34: 596–606, 1999). May be employed in immune modulation, gut adhesion, cell wall synthesis, survival, and polysaccharide production. |

TABLE 1-continued

| SEQ ID NO: DNA | SEQ ID NO: PROT | Category | Description |
|---|---|---|---|
| | | Altered metabolic properties. Altered probiotic attributes. Modified health properties (including immunoregulatory, anticancer, gut health). Modified antibiotic resistance. Improved antimicrobial properties. | |
| 17 | 140 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer gut health). Modified antibiotic resistance. Improved antimicrobial properties. | Homologue of plnH. PlnH is the accessory factor for ABC transporter plnG with strong similarities to the proposed transport proteins of several other bacteriocins and to proteins implicated in the signal-sequence-independent export of E. coli hemolysin (Huhne et al., Microbiol. 142: 1437–1448, 1996). LcnD is an accessory protein of Lactococcus lactis with similarities to other proteins involved in the secretion of various polypeptides. They operate in conjunction with a protein from the family of ABC1 transporters. The accessory proteins of Gram-negative bacteria are proposed to form a family of so-called membrane fusion proteins. It is hypothesized that they connect the inner and the outer membranes to facilitate the passage of substrates. CvaA, a member of the membrane fusion protein family, involved in the secretion of colicin V, has been shown to interact with both a cytoplasmic membrane protein (the ABC transporter) and a protein present in the outer membrane (Franke et al., J. Biol. Chem. 274: 8484–8490, 1999). May be employed as an antibacterial for control of infection and food preservation. |
| 18, 121 | 141, 252 | | Homologue of Glyceraldehyde 3-phosphate dehydrogenase (GAPDH) (EC 1.2.1.12) is a tetrameric NAD-binding enzyme common to both the glycolytic and gluconeogenic pathways that catalyzes reversibly the oxidative phosphorylation of D-glyceraldehyde 3-phosphate (G3P) to form 1,3-diphosphoglycerate (1,3-dPG) in the presence of NAD and inorganic phosphate. This enzyme is useful in manipulating alcohol dehydrogenation in vitro or in vivo, e.g. in fermentation processes or with transgenic bacteria with deleted, added or modified alcohol dehydrogenase gene. It can also be useful as a controlled expression vector. |
| 19 | 142 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Modified carbohydrate levels or | Homologue of the histidine-containing protein ptsH, also known as the phosphocarrier protein HPr. Hpr is a component of the phosphoenolpyruvate-dependent sugar phosphotransferase system (PTS), a major carbohydrate active-transport system. The phosphoryl group from phosphoenolpyruvate (PEP) is transferred to the phosphoryl carrier protein HPr by enzyme I. Phospho-HPr then transfers it to the permease (enzymes II/III). HPr is common to all PTS and belongs to the HPr family. The HPr family consists of bacterial proteins, all of which function as phosphoryl transfer proteins. They are |

TABLE 1-continued

| SEQ ID NO: DNA | SEQ ID NO: PROT | Category | Description |
|---|---|---|---|
| | | functional properties. Altered metabolic properties. Modified carbohydrate metabolism. Altered probiotic attributes. Improved fermentation properties or other industrially useful processes. Organisms or materials with improved health properties (including immunoregulatory, anticancer, gut health, lactose tolerance) | energy-coupling constituents of the phosphotransferase system (PTS) (TC # 4.A.1–4.A.6). which catalyzes sugar uptake via a group translocation mechanism. The *E. coli* genome encodes five HPr paralogues that function in PTS-related regulatory capacities. May be employed in survival and carbohydrate metabolism and as a controlled expression vector. |
| 20 | 143 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Modified carbohydrate levels or functional properties. Altered metabolic properties. Modified citrate metabolism. Altered probiotic attributes. Improved fermentation properties or other industrially useful processes. Organisms or materials with improved health properties (including immunoregulatory, anticancer, gut health, lactose tolerance) | Homologue of gamma (acyl carrier protein) subunit of citrate lyase. Citrate lyase (EC 4.1.3.6.) is part of the citrate metabolism pathway and catalyzes the cleavage of citrate to oxaloacetate and acetate and is composed of three subunits (alpha, beta, and gamma). Lactobacillae contribute through the citrate metabolism actively to the flavor development of fermented dairy products (e.g., Dutch cheeses). It is also involved in citrate metabolism pathway that results in lactic acid production and acid tolerance (Magni et al., J. Bacteriol. 181: 1451–1457, 1999) and may be employed in survival and carbohydrate metabolism. |
| 20 | 144 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Modified carbohydrate levels or functional properties. Altered metabolic properties. Modified citrate metabolism. Altered probiotic attributes. Improved fermentation properties or other industrially useful processes. Organisms or materials with improved health properties (including immunoregulatory, anticancer, gut health, lactose tolerance). | Homologue of beta (citryl-S-ACP lyase) subunit of citrate lyase. Citrate lyase (EC 4.1.3.6.) is part of the citrate metabolism and catalyzes the cleavage of citrate to oxaloacetate and acetate and is composed of three subunits (alpha, beta, and gamma). Lactobacillae contribute through the citrate metabolism actively to the flavor development of fermented dairy products (e.g., Dutch cheeses). It is also involved in citrate metabolism pathway that results in lactic acid production and acid tolerance (Magni et al., J. Bacteriol. 181: 1451–1457, 1999) and may be employed in survival and carbohydrate metabolism. |
| 20 | 145 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein | Homologue of alpha subunit (citrate: acetyl-ACP transferase) of citrate lyase. Citrate lyase (EC 4.1.3.6.) is part of the citrate metabolism and catalyzes the cleavage of citrate to oxaloacetate and acetate and is composed of three subunits (alpha, beta, and gamma). Lactobacillae contribute through the citrate metabolism actively to the flavor development of fermented dairy |

TABLE 1-continued

| SEQ ID NO: DNA | SEQ ID NO: PROT | Category | Description |
|---|---|---|---|
| | | manipulations.<br>Altered survival characteristics: survival of industrial processes, growth or storage in product formats, persistence in gut environment.<br>Modified carbohydrate levels or functional properties.<br>Altered metabolic properties.<br>Modified citrate metabolism.<br>Altered probiotic attributes.<br>Improved fermentation properties or other industrially useful processes.<br>Organisms or materials with improved health properties (including immunoregulatory, anticancer, gut health, lactose tolerance). | products (e.g., Dutch cheeses). It is also involved in citrate metabolism pathway that results in lactic acid production and acid tolerance (Magni et al., J. Bacteriol. 181: 1451–1457, 1999) and may be employed in survival and carbohydrate metabolism. |
| 21, 119 | 146, 243 | Removal of undesirable flavor characteristics.<br>Production of desirable flavors.<br>Modified flavor, aroma, or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Modified carbohydrate levels or functional properties.<br>Altered metabolic properties.<br>Modified carbohydrate metabolism.<br>Altered probiotic attributes.<br>Improved fermentation properties or other industrially useful processes.<br>Organisms or materials with improved health properties (including immunoregulatory, anticancer, gut health, lactose tolerance). | Homologue of malic enzyme (EC 1.1.1.39). Malic enzyme catalyzes L-malate oxidative decarboxylation and pyruvate reductive carboxylation and a malate transport protein (similar to citP) involved in membrane potential generation via malate/lactate exchange. Because lactobacilli appear not to have a functioning Krebs cycle, this enzyme may be involved in carbohydrate metabolism, amino acid biosynthesis or L-malate utilization pathways. |
| 22 | 147 | Construction of genetic vectors for controlled expression of RNA and/or protein, fusion protein production, genetic modification, mutagenesis amplification of genetic material or for other genetic or protein manipulations.<br>Production of desirable flavors.<br>Modified flavor, aroma and/or texture attributes.<br>Altered survival characteristics: survival of industrial processes, growth or storage in product formats, persistence in gut environment,<br>Altered viability in response to stress conditions.<br>Increased resistance to high salt levels.<br>Altered metabolic properties or regulation of metabolic pathways.<br>Altered probiotic attributes. | Homologue of otsA, encoding trehalose-6-phosphate synthetase (UDP forming) (EC 2.4.1.15). OtsA combines two glucose molecules to trehalose. Trehalose plays a protective role in the ability of many organisms to tolerate adverse environmental conditions (Fernandes et al., Lett. Appl. Microbiol. 32: 42, 2001) and acts as an osmoprotectant as well as a carbon source (Rimmele and Boos, J. Bacteriol. 176: 5654–5664, 1994). May be involved in carbohydrate and amino acid metabolism, survival and may have utility as a controlled expression vector. |
| 23 | 148 | Construction of genetic vectors for controlled expression of RNA and/or protein, fusion protein production, genetic modification, mutagenesis amplification of genetic material or for other genetic or protein manipulations. | Homologue of trehalose-6-phosphate hydrolase (EC 3.2.1.93). Trehalose-6-phosphate hydrolase is the key enzyme of the phosphotransferase system and hydrolyzes trehalose-6-phosphate to glucose and glucose 6-phosphate. The enzyme shows strong homology with |

TABLE 1-continued

| SEQ ID NO: DNA | SEQ ID NO: PROT | Category | Description |
|---|---|---|---|
| | | Production of desirable flavors.<br>Modified flavor, aroma and/or texture attributes.<br>Altered survival characteristics: survival of industrial processes, growth or storage in product formats, persistence in gut environment.<br>Altered viability in response to stress conditions.<br>Increased resistance to high salt levels.<br>Altered metabolic properties or regulation of metabolic pathways.<br>Altered probiotic attributes. | those of oligo-1,6- glucosidases. Trehalose plays a protective role in the ability of many organisms to tolerate adverse environmental conditions (Fernandes et al., Lett. Appl. Microbiol. 32: 42, 2001) and acts as an osmoprotectant as well as a carbon source (Rimmele and Boos, J. Bacteriol. 176: 5654–5664, 1994). May be involved in carbohydrate and amino acid metabolism, survival and may have utility as a controlled expression vector. |
| 24 | 149 | Construction of genetic vectors for controlled expression of RNA and/or protein, fusion protein production, genetic modification, mutagenesis amplification of genetic material or for other genetic or protein manipulations.<br>Production of desirable flavors.<br>Modified flavor, aroma and/or texture attributes.<br>Altered survival characteristics: survival of industrial processes, growth or storage in product formats, persistence in gut environment.<br>Altered viability in response to stress conditions.<br>Increased resistance to high salt levels.<br>Altered metabolic properties or regulation of metabolic pathways.<br>Altered probiotic attributes. | Homologue of proV. ProV is a glycine betaine/proline transporter that also transports proline betaine, carnitine, dimethyl proline, homobetaine, g-butyrobetaine and choline with low affinity (TC-Number: 3.A.1.12.1). ProV belongs to the ABC substrate binding protein-dependent transporter superfamily, May be involved in carbohydrate and amino acid metabolism, survival and may have utility as a controlled expression vector. |
| 25 | 150 | Altered cell wall or cell surface characteristics, structures or functions.<br>Modified adhesion to human or animal cells or cell lines.<br>Production of desirable flavors.<br>Modified flavor, aroma and/or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health).<br>Modified antibiotic resistance.<br>Improved antimicrobial properties.<br>Regulation of polysaccharide production, adhesion, immune modulation. | Homologue of rgg which positively regulates the expression of extracellular glucosyltransferase (GTF). rgg-like determinants make up a widely occurring gene family in pathogenic and commensal bacterial species and appear to share positive regulatory functions (Vickerman and Minick, Infect. Immun. 70: 1703–1714, 2002). |
| 26 | 151 | Altered cell wall or cell surface characteristics, structures or functions.<br>Modified adhesion to human or animal cells or cell lines.<br>Production of desirable flavors.<br>Modified flavor, aroma and/or texture attributes. | Homologue of Cps14D. Cps gene products are involved in bacterial capsular polysaccharide (CP) biosynthesis. Bacterial CPs are generally composed of repeating oligosaccharides and are involved in resistance to opsonophagocytosis, avoidance of the immune system of the |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Regulation of polysaccharide production, adhesion, immune modulation. | host and attachment. Cps genes are normally clustered on the bacterial chromosome and have a common genetic organization involving three functional regions. Cps14D codes for a protein involved in chain length determination and export of CP (Kolkman et al., J. Biol. Chem. 272: 19502–19508, 1997). |
| 27 | 152 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Regulation of polysaccharide production, adhesion, immune modulation. | Homologue of a Cps-like gene product. Cps-like gene products are involved in bacterial capsular polysaccharide (CP) biosynthesis. Bacterial CPs are generally composed of repeating oligosaccharides and are involved in resistance to opsonophagocytosis, avoidance of the immune system of the host and attachment. Cps genes are normally clustered on the bacterial chromosome and have a common genetic organization involving three functional regions (Kolkman et al., J. Biol. Chem. 272: 19502–19508, 1997). Cps14J encodes a beta-1,4-galactosyltransferase that requires beta-linked GlcNAc as an acceptor. |
| 28 | 153 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. | Homologue of a Cps-like gene product. Cps-like gene products are involved in bacterial capsular polysaccharide (CP) biosynthesis. Bacterial CPs are generally composed of repeating oligosaccharides and are involved in resistance to opsonophagocytosis, avoidance of the immune system of the host and attachment. Cps genes are normally clustered on the bacterial chromosome and have a common genetic organization involving three functional regions. (Kolkman et al., J. Biol. Chem. 272: 19502–19508, 1997). Cps14L encodes a transporter for the repeating unit of the polysaccharide (Kolkman et al. J. Biochem. 123: 937–945, 1998). |

TABLE 1-continued

| SEQ ID NO: DNA | SEQ ID NO: PROT | Category | Description |
|---|---|---|---|
| | | Altered metabolic properties. Altered probiotic attributes. Modified health properties (including immunoregulatory, anticancer, gut health). Modified antibiotic resistance. Improved antimicrobial properties. Regulation of polysaccharide production, adhesion, immune modulation. | |
| 29, 30 | 154, 155 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Regulation of polysaccharide production, adhesion, immune modulation. | Homologue of D-alanyl-D-alanine carboxypeptidase (EC 3.4.17.8, formerly EC 3.4.12.6). D-alanyl-D-alanine carboxypeptidase is a periplasmic membrane-attached protein involved in the construction and maintenance of the bacterial cell walls and also a penicillin binding protein involved in the late stages of murein synthesis. Peptidases are important in the process of cheese ripening and the development of cheese flavor. May have utility as a controlled expression vector. |
| 31 | 156 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | Homologue of aggregation protein aggH. Transgenic microbes with added, deleted or modified aggregation protein gene can have a modified aggregation response in vitro (useful in bioprocessing with bacteria, e.g. fermentation, flocculation) or in vivo (useful in enhancing/decreasing clumping of bacteria, e.g. in gastrointestinal tract, as desired). Aggregation protein gene can be used also for production of protein as antigen to vaccinate mammals. Gene can be used as vehicle for vaccination by fusing with an exogenous antigen with it, transforming a bacterium and treating the mammal to be immunized with killed or live bacteria for preventive or therapeutic vaccination (see patent WO9947657-A2; *Lactobacillus reuteri* bacterial aggregation protein). The aggregation protein is targeted for the bacterial surface, so this ensures efficient antigen presentation to the immune system as the Lactobacillus or other gastrointestinal bacteria adhere to epithelial cells. Finally, gene is useful for detecting Lactobacillus species using the DNA as detection probe. |
| 32 | 157 | Altered cell wall or cell surface characteristics, structures or functions. Modified adhesion to human or animal cells or cell lines. | Homologue of exopolyphosphatase (PPX) (EC 3.6.1.11). Polyphosphate is made by polyphosphate kinase PPK (EC 2.7.4.1) and is broken down by PPX. |

TABLE 1-continued

| SEQ ID NO: DNA | SEQ ID NO: PROT | Category | Description |
|---|---|---|---|
| | | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | |
| 33 | 158 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | Homologue of a peptidoglycan (mureins) bound protein with an LPXTG motif similar to an adhesin. Adhesins mediate attachment of cells to collagen-containing substrata. Type I membrane protein. Collagen binding is important property in attachment and potential pathogenesis of various bacteria with mammalian hosts. The gene can be used to screen bacteria with DNA or protein probes/antibodies for the presence of collagen adhesion gene in various pathogenic and non-pathogenic bacteria, e.g. for selection of strains or for diagnostic purposes (see e.g. patent WO9207002). It is known that expression of a collagen adhesin is essential for the attachment of Staphylococcus aureus to cartilage, which contains collagen (Switalski et al., Mol. Microbiol. 7: 99–107, 1993). Deletion/addition or modification of the gene can alter collagen-binding properties of cells to the desired effect in bacteria-host interactions. Finally, protein can be used as an administered reagent in in vitro or in vivo collagen binding reactions. |
| 34 | 159 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. | Homologue of a bacterial hemolysin. Hemolysin is a bacterial toxin gene that can be used to develop vaccines against pathogenic bacteria carrying the gene/protein. Transgenic microbes with added, deleted or modified hemolysin protein gene can have a modified hemolytic activity in vitro (useful e.g. in bacteria-based assays) or in vivo (useful in enhancing/decreasing pathogenicity of bacteria, as desired (see e.g. J. Biol. Chem. 267: 10902–10909, 1992). Functional expression of the alpha-hemolysin gene of Staphylococcus aureus in intact E. coli and in cell lysates. Deletion of five C-terminal amino acids selectively impairs hemolytic activity. The peptide itself can be used as a reagent e.g. in in vitro assays of hemolytic activity. May be invovled in scavenging iron |

TABLE 1-continued

| SEQ ID NO: DNA | SEQ ID NO: PROT | Category | Description |
|---|---|---|---|
| | | Modified health properties (including immunoregulatory, anticancer, gut health). Modified antibiotic resistance. Improved antimicrobial properties. Improved fermentation properties or other industrially useful processes. | from environment, and therefore is involved in cell survival and metabolism, as well as restricting growth of surrounding microbes. |
| 35 | 160 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. Regulation of cell numbers and growth. | Homologue of autoinducer 2 (AI-2). AI-2 participates in quorum sensing in bacteria. Autoinducer is secreted by bacteria and is used to communicate both the cell density and the metabolic potential of the environment. The gene can be used in DNA or protein assays to detect presence of the DNA or protein in microbes. The deletion, addition or modification of the gene can change the intercellular signaling of bacteria, affecting their growth mode, pathogenesis and survival. The peptide can be used as a reagent to modify the bacterial communication in vitro or in vivo. |
| 36 | 161 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. Regulation of cell numbers and growth. | Homologue of autolysin. Autolysins control the lysis bacterial cells. It can be used for controlling lysis of food fermenting bacteria, e.g. in cheese production, as well as lysis of pathogenic organisms with in vivo or in vitro administration of the peptide or peptide-producing microorganisms. The deleted/added or modified gene in transgenic bacteria can be used to modify the lysis process as required. The DNA and peptide can be used in developing and using various screening assays to detect presence of hemolysin gene/protein and autolytic activity. |
| 37–39 | 162–164 | Altered cell wall or cell surface characteristics, structures or functions. Modified adhesion to human or animal cells or cell lines. Production of desirable flavors. Modified flavor, aroma and/or texture attributes. | Homologue of a bacterial hemolysin. Hemolysin is a bacterial toxin gene that can be used to develop vaccines against pathogenic bacteria carrying the gene/protein. Transgenic microbes with added, deleted or modified hemolysin protein gene can have a modified hemolytic activity in vitro |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. Regulation of cell numbers and growth. | (useful e.g. in bacteria-based assays) or in vivo (useful in enhancing/decreasing pathogenicity of bacteria, as desired (see e.g. J. Biol. Chem. 267: 10902–10909, 1992). Functional expression of the alpha-hemolysin gene of *Staphylococcus aureus* in intact *E. coli* and in cell lysates. Deletion of five C-terminal amino acids selectively impairs hemolytic activity. The peptide itself can be used as a reagent e.g. in in vitro assays of hemolytic activity. May be invovled in scavenging iron from environment, and therefore is involved in cell survival and metabolism, as well as restricting growth of surrounding microbes. |
| 40, 41 | 165, 166 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of penicillin-binding proteins (PBPs). PBPs are enzymes involved in the final stages of peptidoglycan biosynthesis. The C-terminal module binds penicillin and catalyzes peptidoglycan cross-linking. The N-terminal domain can have transglycosylase activity (class A HMW PBPs). PBPs are the targets of beta-lactam antibiotics, which covalently bind to these proteins, inhibiting cell wall synthesis (Mariana et al., J. Bacteriol. 182: 1074–1079, 2000). Penicillin-binding protein gene can be used for modifications in transgenic bacteria, which can change their susceptibility to penicillin (see e.g. Smith and Klugman, Antimicrob. Agents Chemother. 42: 1329–1333, 1998). Alterations in PBP 1A essential-for high-level penicillin resistance in *Streptococcus pneumoniae*. The DNA or protein can be used in various assays to detect the presence of the gene or protein in various biological samples, where penicillin binding is of interest. |
| 42 | 167 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. | Homologue of penicillin-binding protein 5 (Pbp5) also known as muramoylpentapeptide carboxypeptidase (EC 3.4.17.8, formerly EC 3.4.12.6). Ppb5 requires a divalent cation for activity. Penicillin-binding proteins (PBPs), targets of beta-lactam antibiotics, are membrane-bound enzymes essential for the biosynthesis of the bacterial cell wall (Sifaoui et al., Antimicrob. Agents Chemother. 45: 2594–2597, 2001). Penicillin-binding protein gene can be used for modifications in transgenic bacteria, which can change their susceptibility to penicillin (see e.g. Smith and Klugman, Antimicrob. Agents Chemother. 42:1329–1333, 1998). Alterations in PBP 1A essential-for high-level penicillin resistance in *Streptococcus pneumoniae*. The DNA or protein can |

TABLE 1-continued

| SEQ ID NO: DNA | SEQ ID NO: PROT | Category | Description |
|---|---|---|---|
| | | Modified health properties (including immunoregulatory, anticancer, gut health). Modified antibiotic resistance. Improved fermentation properties or other industrially useful processes. | be used in various assays to detect the presence of the gene or protein in various biological samples, where penicillin binding is of interest. |
| 43 | 168 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of penicillin-binding protein 1B (Pbp1b) or murein polymerase. Penicillin-binding proteins (PBPs), targets of beta-lactam antibiotics, are membrane-bound enzymes essential for the biosynthesis of the bacterial cell wall. PBPs possess a penicillin-insensitive transglycosylase n-terminal domain (formation of linear glycan strands) and a penicillin-sensitive transpeptidase c-terminal domain (cross-linking of the peptide subunits) responsible for the final steps of the bacterial cell wall polymerization and cross-linking, respectively (Zhao et al., Protein Expr. Purif. 16: 331–339, 1999). Penicillin-binding protein gene can be used for modifications in transgenic bacteria, which can change their susceptibility to penicillin (see e.g. Smith and Klugman, Antimicrob. Agents Chemother. 42: 1329–1333, 1998). Alterations in PBP 1A essential-for high-level penicillin resistance in Streptococcus pneumoniae. The DNA or protein can be used in various assays to detect the presence of the gene or protein in various biological samples, where penicillin binding is of interest. |
| 44, 110 | 169, 234 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified adhesion to human or animal cells or cell lines. Organisms or materials with improved health properties (including immunoregulatory, anticancer, gut health) Altered resistance to antibiotics. Improved antimicrobial properties. | Homologue of protein p60, encoded by the gene termed iap. p60 protein is a major extracellular product secreted by all isolates of Listeria monocytogenes. This protein has peptidoglycan hydrolase activity but also influences the uptake of L. monocytogenes by non-phagocytic cells. Proteins related to p60 are found in all other Listeria species. It has been shown that p60 protein is among the strongest antigens in listeriae for B- and T-cell responses. The protein p60 belongs to the E. coli nlpc/listeria p60 family. This gene can be useful as a probe to detect the presence of the gene/protein in various bacteria. Deletion, addition and modification of the gene in transgenic bacteria can alter their extracellular envelope structure, thereby altering their growth and pathogenicity characteristics. See e.g. Bubert et al., J. Bacteriol. 174: 8166–8171, 1992. |
| 45 | 170 | Altered cell wall or cell surface characteristics, structures or functions. Modified adhesion to human or animal cells or cell lines. Production of desirable flavors. Modified flavor, aroma and/or texture attributes. | Homologue of flotillin. Flotillins have been found in mammalian, insect and bacterial cells and behave as resident integral membrane protein components of caveolae which are plasmalemmal microdomains that are involved in vesicular trafficking and signal transduction (Huang et al., Mol. |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health).<br>Modified antibiotic resistance.<br>Improved antimicrobial properties. | Microbiol. 31: 361–371, 1999).<br>Flotillins (also known as epidermal surface antigens (ESAs)) belong to the family of caveolae-associated integral membrane proteins and may act as a scaffolding protein within caveolar membranes. This gene is similar to an epidermal surface antigen of *Bacillus subtilis*. It is useful as a vaccine development target. |
| 46 | 171 | Altered cell wall or cell surface characteristics, structures or functions.<br>Modified adhesion to human or animal cells or cell lines.<br>Production of desirable flavors.<br>Modified flavor, aroma and/or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health).<br>Modified antibiotic resistance.<br>Improved antimicrobial properties. | Homologue of fimbria associated protein. Fimbriae and pili are interchangeable terms used to designate short, hair-like structures on the surfaces of prokaryotic cells composed of protein. Fimbriae are most often involved in adherence of bacteria to surfaces, substrates and other cells in nature. This gene is similar to sortase, which is involved in covalent anchoring to the cell wall (see Cossart and Jonquieres, Proc. Natl. Acad. Sci. USA 97: 5013–5015, 2000). The gene is useful as a target for antibiotic development as the gene performs a very important function in cell wall protein anchoring. The DNA and protein can be used in vitro and in vivo assays and treatments as a reagent. Transgenic bacteria with deleted, added or modified sortase gene can have modified protein anchoring at the cell surface layer. |
| 47 | 172 | Altered cell wall or cell surface characteristics, structures or functions.<br>Modified adhesion to human or animal cells or cell lines.<br>Production of desirable flavors.<br>Modified flavor, aroma and/or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health).<br>Modified antibiotic resistance.<br>Improved antimicrobial properties. | Homologue of a collagen binding protein. Collagen binding is important property in attachment and potential pathogenesis of various bacteria with mammalian hosts. The gene can be used to screen bacteria with DNA or protein probes/antibodies for the presence of collagen adhesion gene in various pathogenic and non-pathogenic bacteria, e.g. for selection of strains or for diagnostic purposes (see e.g. patent WO9207002). It is known that expression of a collagen adhesin is essential for the attachment of *Staphylococcus aureus* to cartilage, which contains collagen (Switalski et al., mol. Microbiol. 7, 99–107, 1993). Deletion/addition or modification of the gene can alter collagen-binding properties of cells to the desired effect in bacteria-host interactions. Finally, protein can be used as an administered reagent in in vitro or in vivo collagen binding reactions. |
| 48 | 173 | Altered cell wall or cell surface characteristics, structures or functions. | Homologue of bacteriophage immunity repressor IMMREP. IMMREP is involved in the regulation |

TABLE 1-continued

| SEQ ID NO: DNA | SEQ ID NO: PROT | Category | Description |
|---|---|---|---|
| | | Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antimicrobial properties. | of lysogeny in the temperate *Bacillus subtilis* phage phi 105, which can make *B. subtilis* immune to infection by phi 105 phage (see Cully and Garro, Gene 38: 153–164, 1985). Can be used to manipulate bacteria as to their susceptibility to phage invasion and hence acquiring desired/undesired genetic element carried by the phage. |
| 49 | 174 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of N-acetylmuramoyl-L-alanine amidase (EC 3.5.1.28). N-acetylmuramoyl-L-alanine amidase hydrolyzes the link between N-acetylmuramoyl residues and L-amino acid residues in certain cell-wall glycopeptides. N-acetylmuramoyl-L-alanine amidases contain a COOH-terminal choline-binding domain and an NH2-terminal catalytic domain. Useful for N-acetylmuramoyl-L-alanine amidase activity using the peptide in vitro or in vivo, or transgenic bacteria with the gene expressed to effect the enzyme activity. The DNA or protein can be used in assays to detect the presence of the gene or protein in various assays. This enterotoxin related gene is also a vaccine development target for pathogenic or other undesired bacteria, e.g. various Lactobacillus strains. |
| 50 | 175 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. | Homologue of hrdT. hrdT is a member of the multidrug resistance exporter (MDR) family (TC# 3.A.1.201) in the ATP-binding Cassette (ABC) Superfamily of transporters. ABC transporters translocate a wide variety of substrates, including amino acids, peptides, ions, sugars, toxins, lipids, and drugs |

TABLE 1-continued

| SEQ ID NO: DNA | SEQ ID NO: PROT | Category | Description |
|---|---|---|---|
| | | Modified carbohydrate levels or functional properties. Altered metabolic properties. Altered probiotic attributes. Improved fermentation properties or other industrially useful processes. Organisms or materials with improved health properties (including immunoregulatory, anticancer, gut health, lactose tolerance) | |
| 51 | 176 | Altered cell wall or cell surface characteristics, structures or functions. Improved antimicrobial properties Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved fermentation properties or other industrially useful processes. | Homologue of adhesin-involved-in-diffuse-adherence (AIDA) a fimbrial adhesin and virG (icsA) protein. VirG and AIDA are precursor virulence factors that transport themselves out of the bacterial cell and are then usually proteolytically digested to release a soluble protein that can promote virulence. They are members of the autotransporter (AT) family of outer membrane proteins and play an important role in virulence. The gene is useful as a target for vaccine development of bacteria having this kind of gene, as well as manipulation of virulence by deletion, addition or modification of the gene in transgenic bacteria. |
| 52 | 177 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of cyclopropane fatty acid synthase (cfa). cfa is similar to the cyclopropane-fatty-acyl-phospholipid synthase of bacteria, and catalyzes a modification of the acyl chains of phospholipid bilayers. This gene is useful in modifying the bacterial phospholipid bilayers by altered enzyme activity, e.g. by deleted, added or modified gene in transgenic bacteria (see e.g. U.S. Pat. No. 5,573,915: Determining the ability of a compound to inhibit the cyclopropanation of mycolic acids in pathogenic mycobacteria). |
| 53 | 178 | Removal of undesirable flavor characteristics. Production of desirable flavors. Modified flavor, aroma, or texture attributes. | Homologue of adhE. adhE encodes a multifunctional dehydrogenase that catalyzes the conversion of acetyl-CoA into ethanol and has acetaldehyde dehydrogenase [acetylating] (EC |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Modified carbohydrate levels or functional properties. Altered metabolic properties. Modified carbohydrate metabolism. Altered probiotic attributes. Improved fermentation properties or other industrially useful processes. Organisms or materials with improved health properties (including immunoregulatory, anticancer, gut health, lactose tolerance). | 1.2.1.10) (ACDH) and alcohol dehydrogenase (ADH) (EC 1.1.1.1) activities (Arnau et al., J. Bacteriol. 180: 3049–3055, 1998). This enzyme is useful in manipulating alcohol dehydrogenation in vitro or in vivo, e.g. in fermentation processes or with transgenic bacteria with deleted, added or modified alcohol dehydrogenase gene. |
| 54 | 179 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of biotin carboxylase (EC 6.3.4.14). Biotin carboxylase is one component of acetyl CoA carboxylase which, in turn, catalyzes the regulated step in long-chain fatty acid synthesis. This enzyme is useful in manipulating biotin carboxylation in vitro or in vivo, e.g. in transgenic plants with deleted, added or modified gene leading to altered biotin metabolism, thus affecting insect herbivores which require plant-derived biotin; may also have utility in manipulation of herbicide tolerance (see U.S. Pat. No. 5,910,626: Acetyl-CoA carboxylase compositions and methods of use). |
| 55 | 180 | Removal of undesirable flavor characteristics. Production of desirable flavors. Modified flavor, aroma, or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Modified carbohydrate levels or functional properties. Altered metabolic properties. Modified carbohydrate metabolism. Altered probiotic attributes. | Homologue of the argE gene product of E. coli. argE is a N-acetyl-L-ornithine deacetylase that can remove the acetyl-group from N-acetylphosphinothricin giving the cytotoxic compound L-phosphinothricin (Pt, glufosinate). This gene is useful in related deacetylase reactions, in vitro or in vivo using the proteins as such, of bacteria engineered to produce the enzyme activity. |

TABLE 1-continued

| SEQ ID NO: DNA | SEQ ID NO: PROT | Category | Description |
|---|---|---|---|
| | | Improved fermentation properties or other industrially useful processes. Organisms or materials with improved health properties (including immunoregulatory, anticancer, gut health, lactose tolerance). | |
| 56 | 181 | Production of bioactive or functional polypeptides. Removal of undesirable flavor characteristics. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties or regulation of metabolic pathways. Altered probiotic attributes. Organisms or materials with improved health properties (including immunoregulatory, anticancer, gut health). Altered resistance to antibiotics. | Homology to serine proteases, which break down milk proteins during the growth of the bacteria on milk. Contains the subtilase pattern of the subtilase family(G-T-S-x-[SA]-x-P-x(2)-[STAVC]-[AG]). Subtilases are an extensive family of serine proteases whose catalytic activity is provided by a charge relay system similar to that of the trypsin family of serine proteases but which evolved by independent convergent evolution. The sequence around the residues involved in the catalytic triad (aspartic acid, serine and histidine) are completely different from that of the analogous residues in the trypsin serine proteases and can be used as signatures specific to that category of proteases. This enzyme is similar to prochymosin, a protein used in cheese making. The gene is useful in protease utilization in protein processing (see e.g. NL8701378; S. cremoris proteinase). |
| 57 | 182 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologoue of GABA permeases. GABA permeases belong to the amino acid-polyamine-organocation (APC) superfamily. This superfamily of transport proteins includes members that function as solute: cation symporters and solute: solute antiporters. They occur in bacteria, archaea, yeast, fungi, unicellular eukaryotic protists, slime molds, plants and animals. This enzyme is similar to linoleate isomerase (see e.g. WO9932604-A1). This gene is useful in enzyme reactions similar to lineolate isomerase, either as a purified protein, or in transgenic organisms containing the gene effecting the enzyme activity. |
| 58 | 183 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. | Homologue of iap. iap is a major extracellular protein in Listeria, and seems to be required for adherence to and invasion of 3T6 mouse fibroblasts. This gene can be useful as a probe to detect the presence of the gene/protein in various bacteria. Deletion, addition and modification of the gene in transgenic bacteria can alter their extracellular envelope structure, thereby altering their growth and pathogenicity characteristics. See e.g. Bubert et al., J. Bacteriol. 174(24): 8166–8171, 1992. Involved in the invasion of cells, could be |

TABLE 1-continued

| SEQ ID NO: DNA | SEQ ID NO: PROT | Category | Description |
|---|---|---|---|
| | | Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | necessary for the export of invasion related determinants. iap mediates adhesion to particular cell surfaces, therefore has utility in persistance in the gut enviroment, probiotic effects and pathogen exclusion. |
| 59 | 184 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of preprotein translocase secY subunit. The sequence contains the protein secY signature 1 pattern (SIFSMGVSPYITAQIVVQLL), the protein secY signature 2 pattern (WMGEQITDKGLGNGVSLLI) and C-5 cytosine-specific DNA methylases C-terminal signature pattern (KGLGNGVSLLIFSGIVARL). The eubacterial secY protein plays an important role in protein export. It interacts with the signal sequences of secretory proteins as well as with two other components of the protein translocation system: secA and secE. SecY is an integral plasma membrane protein of 419 to 492 amino acid residues that apparently contains ten transmembrane segments. Such a structure probably confers to secY a 'translocator' function, providing a channel for periplasmic and outer-membrane precursor proteins. This gene is useful for enhancing extracellular protein production by improved transport from cell (see e.g. JP5153979A2: Sec Y protein gene) |
| 60 | 185 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered amino acid metabolism. Altered probiotic attributes. Modified health properties (including immunoregulatory, anticancer, gut health, apoptosis). Modified antibiotic resistance. Improved antimicrobial properties. Improved fermentation properties or other industrially useful processes. | Homolougue of cationic amino acid transport protein ctrA. As a cell surface protein, ctrA has been shown to give a strong response as antigen and could be used as a prominent target for antibodies and diagnostic procedures or vaccine development (surface location enhances its exposure to the immune system). Amino acid acid metabolism plays a role not only in metabolism and growth, but also in the production of flavour and aroma compounds. Control over the import of amino acids will modulate the production of these compounds. |

TABLE 1-continued

| SEQ ID NO: DNA | SEQ ID NO: PROT | Category | Description |
|---|---|---|---|
| 61 | 186 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or Protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. Vaccine development. | Homologue of lipoprotein plpB. Bacterial surface lipoproteins give strong responses as antigens and could be used as prominent targets for antibodies and diagnostic procedures. Thus, is useful in vaccine development (surface location enhances its exposure to the immune system). May also have a role in solute binding and adhesion to cell surfaces. |
| 62 | 187 | Altered cell wall or cell surface characteristics, structures or functions. Altered amino acid metabolism. Removal of undesirable flavor characteristics. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. | Homologue of dihydrodipicolinate synthase (EC 4.2.1.52). Dihydrodipicolinate synthase catalyzes the first step in the biosynthesis of diaminopimelate and lysine from aspartate semialdehyde; L-aspartate 4-semialdehyde and pyruvate to dihydrodipicolinate and water. It is feedback-inhibited by lysine and belongs to the dihydrodipicolinate synthetase (DHDPS) family. This gene is involved in bacterial wall synthesis, and is thus a target for antibiotic development, as its inhibition would affect growth of the bacterium. |
| 63 | 188 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered viability in response to stress conditions. Improved stress-response Altered probiotic attributes. Vaccine development. | Homologue of GroEL, a heat shock protein, which makes up the GroE chaperonin system in bacteria together With GroE. It is involved in the folding and assembly of newly synthesized polypeptide chains released from the translation machinery and the refolding of stress-denatured proteins. GroEL, a member of the hsp60 family is a highly conserved heat-shock chaperonin protein and is an oligomer of 14 subunits composed of two stacked rings of 7 subunits. This gene is similar to a gene used in mycobacterial vaccine development, and is thus a target for antibiotic development, as its inhibition would affect growth of the bacterium (see e.g. WO9932634-A2: |

TABLE 1-continued

| SEQ ID NO: DNA | SEQ ID NO: PROT | Category | Description |
|---|---|---|---|
| | | | Compositions derived from *Mycobacterium vaccae* and methods for their use). Also noted as having a role in resistance to environmental stress conditions. |
| 64 | 189 | Altered cell wall or cell surface characteristics, structures or functions.<br>Modified adhesion to human or animal cells or cell lines.<br>Production of desirable texture.<br>Modified flavor, aroma and/or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health, apoptosis).<br>Modified antibiotic resistance.<br>Improved antimicrobial properties.<br>Improved fermentation properties or other industrially useful processes. | Homologue of hyaluronan synthase. Hyaluronan (or hyaluronic acid or hyaluronate; HA) is a polysaccharide of the glycosaminoglycans class found in the extracellular matrix of vertebrate tissues and in the surface coating of certain Streptococcus and Pasteurella bacterial pathogens. It is a unique biopolymer found in all tissues and body fluids in every mammalian species as well as in microorganisms. HA synthases (HASs) are the enzymes that polymerize HA using uridine diphospho-sugar precursors. In all known cases, HA is secreted out of the cell; therefore, HASs are normally found in the outer membranes of the organism. They were the first class of glycosyltransferases identified in which a single polypeptide species catalyzes the transfer of two different monosaccharides; this finding is in contrast to the usual 'single enzyme, single sugar' dogma of glycobiology. Derivatizing and complexing hyaluronan with other substances makes it possible to create bioactive (e.g. anti-thrombogenic, anti-bacterial) surfaces. This gene is involved in pathogenesis with cell-cell interactions, differentiation, tissue repair. The gene is also similar to an Enterococcus antigen that is useful in vaccine development (see e.g. WO9850554-A2; *Enterococcus faecalis* antigenic polypeptide fragment EF017). |
| 65, 111 | 190, 235 | Altered cell wall or cell surface characteristics, structures or functions.<br>Modified adhesion to human or animal cells or cell lines.<br>Production of desirable flavors.<br>Modified flavor, aroma and/or texture attributes.<br>Construction of genetic vectors for controlled expression of RNA and/or protein, fusion protein production, genetic modification, mutagenesis amplification of genetic material or for other genetic or protein manipulations.<br>Altered survival characteristics: survival of industrial processes, growth or storage in product formats, persistence in gut environment.<br>Altered metabolic properties.<br>Altered probiotic attributes.<br>Modified health properties (including immunoregulatory, anticancer, gut health).<br>Modified antibiotic resistance.<br>Improved antimicrobial properties. | Homologue of MurD. MurD encodes UDP-N-acetylmuramoylalanine - D-glutamate ligase (EC 6.3.2.9) also known as UDP-N-acetylmuramoyl-L-alanyl-D-glutamate synthetase or D-glutamic acid adding enzyme catalyzes the addition of D-glutamate to the nucleotide precursor UDP-N-acetylmuramoyl-l-alanine (UMA)and belongs to the cytoplasmic peptidoglycan synthetases involved in cell wall formation. Thus it is useful for antibiotic development to inhibit bacterial cell wall synthesis. |

TABLE 1-continued

| SEQ ID NO: DNA | SEQ ID NO: PROT | Category | Description |
|---|---|---|---|
| 66 | 191 | Altered cell wall or cell surface characteristics, structures or functions. Modified adhesion to human or animal cells or cell lines. Production of desirable texture. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of transmembrane glycoprotein involved in nephritis (inflammation of the kidney). |
| 67 | 192 | Altered amino acid metabolism. Removal of undesirable flavor characteristics. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). | Homologue of glutamine transport ATP-binding protein glnQ (TC# 3.A.1.3.2). glnQ belongs to the polar amino acid uptake transporter (PAAT) family (TC# 3.A.1.3) of the ATP-binding Cassette (ABC) superfamily of transporters. The enzymatic degradation of amino acids in cheese plays a major role in cheese flavor development. Amino acid degradation products greatly contribute to flavor or to off-flavors (Rijnen et al., Appl. Environ. Microbiol. 65: 4873–4880, 1999). |
| 68 | 193 | Altered cell wall or cell surface characteristics, structures or functions. Modified adhesion to human or animal cells or cell lines. Production of desirable texture. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. | Homologue of fibronectin/fibrinogen-binding protein like FBP54. FBP54 is a surface protein that reacts with both fibronectin and fibrinogen and therefore may participate in the adhesion of bacteria to host cells. This gene is involved in bacterial entry into mammalian cells (see Joh et al., Matrix Biol. 18: 211–223, 1999). Thus this gene is useful in manipulation of the binding process to alter pathogenicity through drugs interfering with the gene product. |

TABLE 1-continued

| SEQ ID NO: DNA | SEQ ID NO: PROT | Category | Description |
|---|---|---|---|
| | | Altered probiotic attributes. Modified health properties (including immunoregulatory, anticancer, gut health, apoptosis). Modified antibiotic resistance. Improved antimicrobial properties. Improved fermentation properties or other industrially useful processes. | |
| 69 | 194 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). Modified antibiotic resistance. Improved antimicrobial properties. Improved fermentation properties or other industrially useful processes. Vaccine development. | Homologue of virulence factor mviM. Bacteria that cause disease have special factors which are designated as virulence factors. These factors contribute to the virulence of the microorganisms and to their survival in the hostile environment within the body of their host. Various signals control the expression of the virulence factors. Oxygen, temperature, concentration of ions, and pH are some of the known signals that change the bacterial virulence. The action of virulence factors ranges from adhesion mediation to target cells to molecular mimicry and mobility to pH buffering. The gene is useful as a target for vaccine development of bacteria having this kind of gene, as well as manipulation of virulence by deletion, addition or modification of the gene in transgenic bacteria. |
| 70 | 195 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of the response regulator cheY. Chemotactic receptors at the bacterial cell surface communicate with flagellar basal structures to elicit appropriate motor behavior in response to extracellular stimuli. Genetic and physiological studies indicate that the product of the cheY gene interacts directly with components of the flagellar motor to control swimming behavior. Response regulators are involved in production of virulence factors, motility, antibiotic resistance and cell replication. Inhibitors of these proteins would be useful in preventing bacterium from progressing to pathogenesis, thus useful in medical treatments against bacteria. May have utility as a controlled expression vector. |
| 71, 112 | 196, 236 | Modified adhesion to human or animal cells or cell lines. Production of desirable flavors. Modified flavor, aroma and/or texture attributes. | Homologue of the mycobacterial RegX3 protein. RegX3 is a response regulator, which together with the histidine kinase SenX3 forms a two-component signal transduction system |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | that is positively autoregulated (Himpens et al., Microbiol. 146: 3091–3098, 2000). Response regulators in bacteria are involved in the bacterium's ability to monitor its surroundings and adapt to changes in its environment. Several of these bacterial regulators are involved in virulence and bacterial pathogenesis within the host (see e.g. U.S. Pat. No. 5,910,572) The response regulators are involved in production of virulence factors, motility, antibiotic resistance and cell replication. Inhibitors of these proteins would be useful in preventing bacterium from progressing to pathogenesis, thus useful in medical treatments against bacteria. May have utility as a controlled expression vector. |
| 72, 113 | 197, 237 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of spinosyn biosynthesis. Spinosyns are macrolides with a 21-carbon, tetracyclic lactone backbone to which the deoxysugars forosamine and tri-O-methylrhamnose are attached. Macrolides interfere with the peptidyltransfer function of the ribosome. The macrolide antibiotics, which include erythromycin, azithromycin, and the streptogramin family among others, work by binding the large ribosomal subunit. The molecular details of the binding site for macrolides are not well understood. The spinosyns, a novel family of insecticidal macrocyclic lactones, are active on a wide variety of insect pests, especially lepidopterans and dipterans (see WO9946387-A1: Biosynthetic genes for spinosyn insecticide production). This gene can be useful in a related compound biosynthesis utilization for bioactive compounds. |
| 73 | 198 | Altered cell wall or cell surface characteristics, structures or functions. Modified adhesion to human or animal cells or cell lines. Production of desirable texture. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health, apoptosis). | Homologue of EpsK protein. EpsK is involved in exopolysaccharide biosynthesis. A broad variety of bacteria produce polysaccharides, which can either be excreted into the environment as exopolysaccharides (EPSs), form a capsule around the cell as capsular polysaccharides, or be attached to the cell membrane as the O antigens of lipopolysaccharides. The biosynthesis of polysaccharides that consist of repeating units includes their assembly on a lipid carrier by sequential transfer of monosaccharides from nucleotide sugars by glycosyltransferases (GTFs) and the subsequent polymerization and export of these repeating units. Secreted exopolysaccharides contribute to the cell protection against environmental influences, attachment to surfaces, nutrient gathering and to antigenicity. Due to the variation of monosaccharide sequences, |

TABLE 1-continued

| SEQ ID NO: DNA | SEQ ID NO: PROT | Category | Description |
|---|---|---|---|
| | | Modified antibiotic resistance. Improved antimicrobial properties. Improved fermentation properties or other industrially useful processes. | condensation linkages and non-carbohydrate decorations, an infinite array of structures can be provided by these sugar polymers. Deletion, addition and modification of the gene in transgenic bacteria can alter their extracellular envelope structure, thereby altering their growth and pathogenicity characteristics. |
| 74 | 199 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of CpxA protein. CpxA is involved in several diverse cellular processes, such as the functioning of acetohydroxyacid synthetase I, in the biosynthesis of isoleucine and valine, the traJ protein activation activity for tra gene expression in F plasmid, and the synthesis, translocation, or stability of cell envelope proteins. It also activates CpxR by phosphorylation. The CpxA-CpxR two-component signal transduction system regulates gene expression in adaptation to adverse conditions. These include envelope protein distress, heat shock, oxidative stress, high pH, and entry into stationary phase. This gene can be useful in manipulation the sensory apparatus related functions by deletion, addition or modification of the gene in transgenic bacteria, or as a drug target to interfere with bacterial signaling systems. May have utility as a controlled expression vector. |
| 75 | 200 | Altered cell wall or cell surface characteristics, structures or functions. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of 1,4-dihydroxy-2-naphthoate octaprenyltransferase. 1,4-dihydroxy-2-naphthoate octaprenyltransferase is a membrane-associated enzyme that converts the soluble bicyclic naphthalenoid compound 1,4-dihydroxy-2-naphthoic acid (DHNA) to membrane-bound demethylmenaquinone, a key step in the menaquinone biosynthesis. |
| 76 | 201 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: | Homologue of the bifunctional bacterial gene HpcE coding for 2-hydroxyhepta-2,4-diene-1,7-dioateisomerase and 5-carboxymethyl-2-oxo-hex-3-ene-1,7-dioatedecarboxylase (EC 5.3.3.—). HpcE produces 2-hydroxyhepta-2,4-diene, 1,7-dioate from 5-carboxymethyl-2-oxo-hex-3-ene-1,5-dioate or 5-Carboxymethyl-2-hydroxymuconate. |

TABLE 1-continued

| SEQ ID NO: DNA | SEQ ID NO: PROT | Category | Description |
|---|---|---|---|
| | | survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | |
| 77 | 202 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of UbiX. UbiX codes for 3-octaprenyl-4-hydroxybenzoate carboxy-lyase (EC 4.1.1.—) and that catalyzes the third reaction in ubiquinone biosynthesis pathway, the conversion of 3-octaprenyl-4-hydroxybenzoate to 2-octaprenyl phenol, and normally functions in association with the cytoplasmic membrane. |
| 78, 114 | 203, 238 | Removal of undesirable flavor characteristics. Modified flavor, aroma, texture attributes. Construction of genetic vectors for controlled expression of RNA and/or protein, fusion protein production, genetic modification, mutagenesis amplification of genetic material or for other genetic or protein manipulations. Altered survival characteristics: (survival of industrial processes, growth or storage in product formats, persistence in gut environment). Modified carbohydrate levels or functional properties. Altered metabolic properties. Modified lactose metabolism. Altered probiotic attributes. Organisms or materials with improved health properties (including immunoregulatory, anticancer, gut health, lactose tolerance). | Homologue of lacG. LacG codes for the enzyme 6-phospho-beta-galactosidase (EC 3.2.1.85) that is part of the lactose metabolism and hydrolyzes phospholactose, the product of a phosphor-enolpyruvate-dependent phosphotransferase system. It belongs to the glycosidase family 1 and contributes to bitter flavor. |
| 79, 115 | 204, 239 | Altered cell wall or cell surface characteristics, structures or functions. Production of desirable flavors. Modified flavor, aroma and/or texture attributes. Construction of genetic vectors for controlled expression of RNA and/or protein, fusion protein production, genetic modification, mutagenesis amplification of genetic material or | Homologue of the dnrH, dpsA-dpsF genes, which encode daunorubicin (DNR)-doxorubicin (DXR) polyketide synthase (PKS). DNR and its C-14-hydroxylated derivative DXR are among the most important antitumor antibiotics in current use. Both antibiotics are produced by Streptomyces peucetius through a pathway involving a type II PKS, which executes the condensation of |

TABLE 1-continued

| SEQ ID NO: DNA | SEQ ID NO: PROT | Category | Description |
|---|---|---|---|
| | | for other genetic or protein manipulations. Altered survival characteristics: survival of industrial processes, growth or storage in product formats, persistence in gut environment. Regulation of metabolic processes. Altered probiotic attributes. Modified health properties (including immunoregulatory, anticancer, gut health, apoptosis). Modified antibiotic resistance. Improved antimicrobial properties. Improved fermentation properties or other industrially useful processes. | propionyl coenzyme A (CoA), as the starter unit, and nine malonyl-CoA extender units in the production of a 21-carbon decaketide (Bao et al., J. Bacteriol. 181: 4690–4695, 1999). |
| 80 | 205 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. Improved antimicrobial properties. Improved fermentation properties or other industrially useful processes. | Homologue of decaprenyl diphosphate (decaprenyl-PP) synthase. Decaprenyl-PP synthase catalyzes the consecutive condensation of isopentenyl diphosphate with allylic diphosphates to produce decaprenyl-PP, which is used for the side chain of ubiquinone (Q)-10. |
| 81, 116 | 206, 240 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. Improved antimicrobial properties. Improved fermentation properties or other industrially useful processes. | Homologue of geranyltranstransferase (EC 2.5.1.10) also known as farnesyl-diphosphate synthase. Geranyltranstransferase catalyzes the basic chain-elongation reaction in the isoprene biosynthetic pathway, the condensation of isopentenyl pyrophosphate with dimethylallyl pyrophosphate to give geranyl pyrophosphate. |
| 82 | 207 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. | Homologue of heptaprenyl diphosphate synthase. Heptaprenyl diphosphate synthase catalyzes the condensation of four molecules of isopentenyl diphosphate with farnesyl diphosphate to give heptaprenyl diphosphate, which is involved in the biosynthesis of the side chain of menaquinone-7 (Zhang et al., J. Bacteriol. 179: 1417–1419, 1997) |

TABLE 1-continued

| SEQ ID NO: DNA | SEQ ID NO: PROT | Category | Description |
|---|---|---|---|
| 83–85, 117 | 208–210, 241 | Altered phosphate metabolism. Altered viability in response to stress conditions. Altered metabolic properties or regulation of metabolic pathways. Altered probiotic attributes. Improved antimicrobial properties. Improved fermentation properties or other industrially useful processes. Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. Improved antimicrobial properties. Improved fermentation properties or other industrially useful processes. | Homologue of the ispE (formerly designated ychB) gene. IspE encodes 4-(cytidine 5'-diphospho)-2-C-methyl-D-erythritol kinase also called 4-diphosphocytidyl-2-C-methyl-D-erythritol kinase (EC 2.7.1.148) that belongs to the non-mevalonate terpenoid biosynthesis pathway and catalyzes the phosphorylation of 4-diphosphocytidyl-2-C-methyl-D-erythritol yielding 4-diphosphocytidyl-2-C-methyl-D-erythritol 2-phosphate (Rohdich et al., Proc. Natl. Acad. Sci. USA 97: 8251–8256, 2000). |
| 86, 88 | 211, 213 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. Improved antimicrobial properties. Improved fermentation properties or other industrially useful processes. | Homologue of MIAA that encodes tRNA delta(2)-isopentenylpyrophosphate transferase (EC 2.5.1.8), which catalyzes the first step in the biosynthesis of 2-methylthio-n6-(delta(2)-isopentenyl)-adenosine (ms[2]i[6]a]) adjacent to the anticodon of several tRNA species. |
| 87 | 212 | Construction of genetic vectors for controlled expression of RNA and/or protein, fusion protein production, genetic modification, mutagenesis amplification of genetic material or for other genetic or protein manipulations. Production of desirable flavors. Modified flavor, aroma and/or texture attributes. Altered survival characteristics: survival of industrial processes, growth or storage in product formats, persistence in gut environment. Altered phosphate metabolism. Altered viability in response to stress conditions. Altered metabolic properties or regulation of metabolic pathways. Altered probiotic attributes. | Homologue of mvaD coding for mevalonate pyrophosphate decarboxylase (EC 4.1.1.33). MvaD is part of the mevalonate pathway for the biosynthesis of the central isoprenoid precursor, isopentenyl diphosphate by catalyzing the reaction of mevalonate 5-diphosphate (MVADP) with ATP to produce isopentenyl diphosphate, ADP, $CO_2$, and inorganic phosphate. |

TABLE 1-continued

| SEQ ID NO: DNA | SEQ ID NO: PROT | Category | Description |
|---|---|---|---|
| | | Improved antimicrobial properties. Improved fermentation properties or other industrially useful processes. | |
| 89, 90 | 214, 215 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | Homologue of mraY, coding for phospho-N-acetylmuramoyl-pentapeptide-transferase (EC 2.7.8.13) also known as UDP-N-acetyl-muramoyl-L-alanyl-D-gamma-glutamyl-L-lysyl-D-alanyl-D-alanine: undecaprenoid-alcohol-phosphate-phospho-N-acetylmuramoyl-pentapeptide-transferase. mraY catalyzes the formation of undecaprenyl-pyrophosphoryl-N-acetylmuramoyl-pentapeptide from UDP-N-acetylmuramoyl-pentapeptide and undecaprenyl-phosphate, the first step in the lipid cycle reactions in biosynthesis of bacterial cell wall peptidoglycans. Phospho-N-acetylmuramoyl-pentapeptide-transferase is an integral membrane protein and belongs to the glycosyltransferase family 4 mraY subfamily. |
| 91, 92 | 216, 217 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | Homologue of UPPS, encoding undecaprenyl pyrophosphate synthetase (EC 2.5.1.31). UPPS catalyzes the Z-oligomerization of isopentenyl units with farnesyl pyrophosphate as a priming substrate to give C50 and C55 prenyl pyrophosphates with Z,E mixed stereochemistry. Undecaprenyl pyrophosphate synthetase is required as a lipid carrier of glycosyl transfer in the biosynthesis of a variety of cell wall polysaccharide components in bacteria. |
| 93, 94 | 218, 219 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. | Homologue of Cps-like gene products are involved in bacterial capsular polysaccharide (CP) biosynthesis. Bacterial CPs are generally composed of repeating oligosaccharides and are involved in resistance to opsonophagocytosis, avoidance of the immune system of the host and attachment. Cps genes are normally clustered on the bacterial chromosome and have a common genetic organization involving three functional regions. Cps14E codes for undecaprenyl-phosphate Glc-1-phosphate transferase that links |

TABLE 1-continued

| SEQ ID NO: DNA | SEQ ID NO: PROT | Category | Description |
|---|---|---|---|
| | | Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. | glucose to an undecaprenylphosphate lipid carrier, the first step in the biosynthesis of enterobacterial common antigen as well as of many O-specific lipopolysaccharides (Kolkman et al., J. Biol. Chem. 272: 19502–19508, 1997). |
| 95, 97 | 220, 221 | Production of bioactive or functional polypeptides. Removal of undesirable flavor characteristics. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties or regulation of metabolic pathways. Altered probiotic attributes. Organisms or materials with improved health properties (including immunoregulatory, anticancer, gut health). Altered resistance to antibiotics. | Homologue of pepV, encoding Xaa-His dipeptidase (EC 3.4.13.3) (carnosinase). PepV is a metalloenzyme member of the metallopeptidase families M20A or M25, with activity against beta-alanyl-dipeptides. It hydrolyzes a broad range of dipeptides including carnosine (beta-alanyl-histidine) but no tri-, tetra-, or larger oligopeptides. PepV in related lactic acid bacteria act as intracellular dipeptidases (Hellendorn et al., J. Bacteriol. 179: 3410–3415) and are important in the final breakdown of casein. PepV mutants exhibit slower growth rates in milk and alter some flavor characteristics. The proteolytic system of lactic acid bacteria is essential for bacterial growth in milk but also for the development of the organoleptic properties of dairy products. PepV is involved both in bacterial growth by supplying amino acids, and in the development of flavor in dairy products, by hydrolyzing peptides (including bitter peptides) and liberating aromatic amino acids which are important precursors of aroma compounds (Fernandez-Espla and Rul, Eur. J. Biochem. 263: 502–510, 1999). |
| 98 | 222 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. Vaccine production. | Homologue of a 19 kDa secreted immunogenic lipoprotein. The 19 kDa lipoprotein gives a strong response as antigen and could be used as a prominent target for antibodies and diagnostic procedures. It is a secreted lipoprotein isolated from *Mycobacterium tuberculosis* (Ashbridge et al. Nucleic. Acids Res. 17: 1249–1253, 1989). It is immunogenic and stimulates TH1-type T cell responses (Mohagheghpour et al., J. Immunol. 161: 2400–2406, 1998). |

TABLE 1-continued

| SEQ ID NO: DNA | SEQ ID NO: PROT | Category | Description |
|---|---|---|---|
| 99 | 223, 253 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Modified antibiotic resistance. Improved antimicrobial properties. Improved fermentation properties or other industrially useful processes. Vaccine production. | Homologue of LecLA2-20, a lectin-like protein LA2-20. Lectins are ubiquitous proteins, which exhibit a specific and reversible sugar-binding activity. They react with glycosylated macromolecules and cells and may coaggragate them and lead to their lysis or alterations (Gilboa-Garber and Garber, FEMS Microbiol. Rev. 5: 211–221, 1989). May have a role in intestinal adhesion via mucin-binding capability (Matsumura et al., J. Dairy Sci. 82: 2523–2529, 1999). |
| 100 | 224 | Altered amino acid metabolism. Removal of undesirable flavor characteristics. Altered cell wall or cell surface characteristics, structures or functions. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered probiotic attributes. Modified health properties (including immunoregulatory, anticancer, gut health). Improved fermentation properties or other industrially useful processes. | Homologue of ilvB that encodes acetolactate synthase (EC 4.1.3.18). IlvB catalyzes the first step common to the biosynthesis of the branched-chain amino acids (valine, leucine and isoleucine). The enzyme catalyzes two parallel reactions: condensation of two molecules of pyruvate to give rise to acetolactate and condensation of pyruvate and alpha-ketobutyrate to yield acetohydroxybutyrate. The enzyme is inhibited by the end products of the pathway (Singh et al., Proc. Natl. Acad. Sci. USA 88: 145 72–4576, 1991). Lactic acid bacteria are nutritionally demanding bacteria which need amino acids for optimal growth. Therefore the branched-chain amino acid (BCAA) biosynthesis pathway is an essential pathway for optimal growth of lactic acid bacteria in milk. Branch chain amino acids impact on cheese flavor (Yvon et al., Appl. Environ. Microbiol. 63: 414–419, 1997). |
| 101 | 225 | Altered amino acid metabolism. Removal of undesirable flavor characteristics. Altered cell wall or cell surface characteristics, structures or functions. production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. | Homologue of ilvG (an isoenzyme of ilvB) that encodes acetolactate synthase (EC 4.1.3.18). IlvG catalyzes the first step common to the biosynthesis of the branched-chain amino acids (valine, leucine and isoleucine). The enzyme catalyzes two parallel reactions: condensation of two molecules of pyruvate to give rise to acetolactate and condensation of pyruvate and alpha-ketobutyrate to yield acetohydroxybutyrate. The enzyme is inhibited by the end products of the pathway (Singh et al., Proc. Natl. Acad. Sci. USA 88: 4572–4576, 1991). Lactic acid bacteria are |

TABLE 1-continued

| SEQ ID NO: DNA | SEQ ID NO: PROT | Category | Description |
|---|---|---|---|
| | | Altered survival characteristics: survival of industrial processes, growth or storage in product formats, persistence in gut environment. Atered metabolic properties. Altered probiotic attributes. Modified health properties (including immunoregulatory, anticancer, gut health). Improved fermentation properties or other industrially useful processes. | nutritionally demanding bacteria which need amino acids for optimal growth. Thus, the branched-chain amino acid (BCAA) biosynthesis pathway is an essential pathway for optimal growth of lactic acid bacteria in milk and impacts on cheese flavor (Yvon et al., Appl. Environ. Microbiol. 63: 414–419, 1997). |
| 102 | 226 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered amino acid metabolism. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of basic surface protein BspA of *Lactobacillus fermentum*. BspA is involved in L-cysteine uptake. BspA is believed to belong to the family III of the bacterial solute-binding proteins and does not contain a lipoprotein consensus sequence (Turner et al., J. Bacteriol. 179: 3310–3316, 1997). Members of the family III solute binding proteins have been shown to bind polar amino acids and opines such as cystine, glutamine, arginine, histidine, lysine, octopine, and nopaline. Implicated in response to oxidative stress (Turner et al., J. Bacteriol. 181: 2192–2198, 1999). |
| 103, 118 | 227, 242 | Altered cell wall or cell surface characteristics, structures or functions. Modified adhesion to human or animal cells or cell lines. Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered probiotic attributes. Modified health properties (including immunoregulatory, anticancer, gut health, apoptosis). Modified antibiotic resistance. Improved antimicrobial properties. Improved fermentation properties or other industrially useful processes. | Homologue of outer membrane lipoprotein gna1946, similar to HlpA of *H. influenzae*. HlpA belongs to the N1pA family of lipoproteins like the iap genes. |
| 104 | 228 | Construction of genetic vectors for controlled expression of RNA and/or protein, fusion protein production, genetic modification, mutagenesis amplification of genetic material or for other genetic or protein manipulations. | Homologue of cold shock protein cspB. CspB is involved in an adaptive process required for cell viability at low temperatures or may function as antifreeze protein. Several bacteria react to a sudden downshift in temperature by the production of a set |

TABLE 1-continued

| SEQ ID NO: DNA | SEQ ID NO: PROT | Category | Description |
|---|---|---|---|
| | | Production of desirable flavors. Modified flavor, aroma and/or texture attributes, Altered survival characteristics: survival of industrial processes, growth or storage in product formats, persistence in gut environment. Altered viability in response to stress conditions. Altered metabolic properties or regulation of metabolic pathways. Altered probiotic attributes. Improved fermentation properties or other industrially useful processes. | of proteins, together forming the cold-shock stimulon, that includes small (7-kDa) cold-shock proteins (CSPs). In a variety of bacteria, families of CSPs, consisting of three to nine members, have been described of which CspA in *E. coli* (CspAE) and CspB in *Bacillus subtilis* (CspBB) are the best characterized. CspAE and CspBB are capable of binding to single-stranded DNA and RNA, and based on these characteristics, several functions for CSPs have been suggested, such as transcriptional activators, RNA chaperones that facilitate the initiation of translation, and freeze-protective proteins. Recently it has been shown that CSPs might regulate the expression of cold-induced genes as antiterminators. Regulation of csp genes takes place at several levels, and for CspAE it was shown that cold-shock induction is achieved at the transcriptional level as well as at the level of mRNA and protein stability (Wouters et al., Appl. Environ. Microbiol 67: 5171–5178, 2001). |
| 105, 120 | 229, 244 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | Homologue of fabF, beta-ketoacyl synthase (acyl carrier protein). FabF is part of the fatty acid biosynthesis (fab) gene cluster (fabD-fabH-acpP-fabF) involved in fatty acid biosynthesis. FabF is the condensing enzyme thought to be responsible for elongation of fatty acids. The fab genes are important in the production of butyric acid, with important flavor and health impacts. It also has antibiotic effects and may be protective against colon cancer (Mortensen and Clausen, Scand. J. Gastroenterol. Suppl. 216: 132–148, 1996). |
| 120 | 245 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. | Homologue of accA, which encodes the acetyl-CoA carboxylase alpha subunit (EC 6.4.1.2). AccA is part of the acc operon. *E. coli* acetyl-CoA carboxylase catalyzes the first committed and rate-controlling step in fatty acid biosynthesis. Fatty acids in gram-positive bacteria act as signaling molecules that are important for cell differentiation (Marini et al., J. Bacteriol. 177: 7003–7006, 1995). |

TABLE 1-continued

| SEQ ID NO: DNA | SEQ ID NO: PROT | Category | Description |
|---|---|---|---|
| | | Modified production of short chain fatty acids. Altered lipid metabolism. Altered probiotic attributes. Organisms or materials with improved health properties (including immunoregulatory, anticancer, gut health) | |
| 120 | 246 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | Homologue of accB encoding biotin carboxyl carrier protein (BCCP), a part of the acc operon. *E. coli* acetyl-CoA carboxylase catalyzes the first committed and rate-controlling step in fatty acid biosynthesis. The overall reaction catalyzed by acetyl-CoA carboxylase proceeds via two half-reactions. To carry out this two-step reaction acetyl-CoA carboxylase requires three distinct components: biotin carboxylase, biotin carboxyl carrier protein, and carboxyltransferase. The biotin carboxylase component catalyzes the first half-reaction, which is an ATP-dependent carboxylation of the vitamin biotin. In vivo, biotin is covalently attached to the biotin carboxyl carrier protein designated as BCCP. (Janiyani et al., J. Biol. Chem. 276: 29864–29870, 2001). Indications are that fatty acids in gram-positive bacteria act as signaling molecules that are important for cell differentiation (Marini et al., J. Bacteriol. 177: 7003–7006, 1995). |
| 120 | 247 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | Homologue of accC encoding the biotin carboxylase (EC 6.3.4.14), a part of the acc operon. *E. coli* acetyl-CoA carboxylase catalyzes the first committed and rate-controlling step in fatty acid biosynthesis. The overall reaction catalyzed by acetyl-CoA carboxylase proceeds via two half-reactions. To carry out this two-step reaction acetyl-CoA carboxylase requires three distinct components: biotin carboxylase, biotin carboxyl carrier protein, and carboxyltransferase. The biotin carboxylase component catalyzes the first half-reaction, which is an ATP-dependent carboxylation of the vitamin biotin. In vivo, biotin is covalently attached to the biotin carboxyl carrier protein designated as BCCP. The second half-reaction, the transfer of the carboxyl group from carboxybiotin to acetyl-CoA to make malonyl-CoA, is catalyzed by the carboxyltransferase component. The chain length of newly synthesized fatty acids depends on the concentration of malonyl-CoA (Janiyani et al., J. Biol. Chem. 276: 29864–29870, 2001). Indications are that fatty acids in gram-positive bacteria act as signaling molecules that are important for cell differentiation (Marini et al., J. Bacteriol. 177: 7003–7006, 1995). |
| 120 | 248 | Production of desirable flavors. Modified flavor, aroma and/or texture attributes. | Homologue of accD encoding the acetyl-coA carboxylase carboxyl transferase subunit beta (EC 6.4.1.2), a |

TABLE 1-continued

| SEQ ID NO: DNA | SEQ ID NO: PROT | Category | Description |
|---|---|---|---|
| | | Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | part of the acc operon. *E. coli* acetyl-CoA carboxylase catalyzes the first committed and rate-controlling step in fatty acid biosynthesis. The overall reaction catalyzed by acetyl-CoA carboxylase proceeds via two half-reactions. To carry out this two-step reaction acetyl-CoA carboxylase requires three distinct components: biotin carboxylase, biotin carboxyl carrier protein, and carboxyltransferase. The biotin carboxylase component catalyzes the first half-reaction, which is an ATP-dependent carboxylation of the vitamin biotin. In vivo, biotin is covalently attached to the biotin carboxyl carrier protein designated as BCCP. The second half-reaction, the transfer of the carboxyl group from carboxybiotin to acetyl-CoA to make malonyl-CoA, is catalyzed by the carboxyltransferase component. The chain length of newly synthesized fatty acids appears to depend on the concentration of malonyl-CoA (Janiyani et al., J. Biol. Chem. 276: 29864–29870, 2001). Indications are that fatty acids in gram-positive bacteria act as signaling molecules that are important for cell differentiation (Marini et al., J. Bacteriol. 177: 7003–7006, 1995). |
| 120 | 249 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | Homologue of fabD, malonyl coenzyme A-acyl carrier protein transacylase, which is part of the fatty acid biosynthesis (fab) gene cluster (fabD-fabH-acpP-fabF) involved in fatty acid biosynthesis. FabD overexpression leads to altered fatty acid composition in E. coli, with increased amounts of cis-vaccenate incorporated into membrane phospholipids. The fab genes are important in the production of butyric acid, with important flavor and health impacts. It also has antibiotic effects and may be protective against colon cancer (Mortensen and Clausen, Scand. J. Gastroenterol. Suppl. 216: 132–148, 1996). |
| 120 | 250 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. | Homologue of fox2, encoding peroxisomal hydratase-dehydrogenase-epimerase (HDE) also known as multifunctional beta-oxidation protein (MFP). Fox2 is the second trifunctional enzyme acting on the beta-oxidation (cellular fatty acid degradation) pathway for fatty acids, possessing hydratase-dehydrogenase-epimerase activities. This enzyme converts trans-2-enoyl-CoA via d-3-hydroxyacyl-CoA to 3-ketoacyl-CoA. |

TABLE 1-continued

| SEQ ID NO: DNA | SEQ ID NO: PROT | Category | Description |
|---|---|---|---|
| | | Modified lipid, glycolipid or free fatty acid levels or functional properties. Modified production of short chain fatty acids. Altered lipid metabolism. Altered probiotic attributes. Organisms or materials with improved health properties (including immunoregulatory, anticancer, gut health) | |
| 120 | 251 | Production of desirable flavors. Modified flavor, aroma and/or texture attributes. Construction of genetic vectors for controlled expression of RNA and/or protein, fusion protein production, genetic modification, mutagenesis amplification of genetic material or for other genetic or protein manipulations. Altered survival characteristics: survival of industrial processes, growth or storage in product formats, persistence in gut environment. Altered metabolic properties. Altered lipid metabolism. Altered probiotic attributes. Organisms or materials with improved health properties (including immunoregulatory, anticancer, gut health). Bioremediation of toxic, carcinogenic or otherwise harmful substances. | Homologue of ncd2 gene, encoding 2-nitropropane dioxygenase (EC 1.13.11.32) also called nitroalkane oxidase. Ncd2 is a flavoprotein that catalyzes the oxidation of nitroalkanes to respective aldehydes or ketones with production of nitrite and water. Nitroalkanes are widely used as industrial solvents, chemical intermediates, explosives and fuels. Several nitroalkanes are toxic and/or carcinogenic. Thus, an enzymatic activity that converts nitroalkanes into less harmful species has significant potential for bioremediation. |

Isolated polynucleotides of the present invention include the polynucleotides identified herein as SEQ ID NOS: 1–121; isolated polynucleotides comprising a polynucleotide sequence selected from the group consisting of SEQ ID NOS: 1–121; isolated polynucleotides comprising at least a specified number of contiguous residues (x-mers) of any of the polynucleotides identified as SEQ ID NOS: 1–121; isolated polynucleotides comprising a polynucleotide sequence that is complementary to any of the above polynucleotides; isolated polynucleotides comprising a polynucleotide sequence that is a reverse sequence or a reverse complement of any of the above polynucleotides; antisense sequences corresponding to any of the above polynucleotides; and variants of any of the above polynucleotides, as that term is described in this specification.

The word "polynucleotide(s)," as used herein, means a single or double stranded polymer of deoxyribonucleotide or ribonucleotide bases and includes DNA and corresponding RNA molecules, including mRNA molecules, both sense and antisense strands of DNA and RNA molecules, and comprehends cDNA, genomic DNA and recombinant DNA, as well as wholly or partially synthesized polynucleotides. A polynucleotide of the present invention may be an entire gene, or any portion thereof. A gene is a DNA sequence which codes for a functional protein or RNA molecule. Operable antisense polynucleotides may comprise a fragment of the corresponding polynucleotide, and the definition of "polynucleotide" therefore includes all operable antisense fragments. Antisense polynucleotides and techniques involving antisense polynucleotides are well known in the art and are described, for example, in Robinson-Benion, et al., "Antisense techniques," *Methods in Enzymol.* 254(23): 363–375, 1995; and Kawasaki, et al., *Artific. Organs* 20 (8): 836–848, 1996.

The definitions of the terms "complement," "reverse complement," and "reverse sequence," as used herein, are best illustrated by the following examples. For the sequence 5' AGGACC 3', the complement, reverse complement, and reverse sequences are as follows:

complement 3' TCCTGG 5'
reverse complement 3' GGTCCT 5'
reverse sequence 5' CCAGGA 3'

Identification of genomic DNA and heterologous species DNA can be accomplished by standard DNA/DNA hybridization techniques, under appropriately stringent conditions, using all or part of a DNA sequence as a probe to screen an appropriate library. Alternatively, PCR techniques using oligonucleotide primers that are designed based on known DNA and protein sequences can be used to amplify and identify other identical or similar DNA sequences. Synthetic DNA corresponding to the identified sequences or variants thereof may be produced by conventional synthesis methods. All of the polynucleotides described herein are isolated and purified, as those terms are commonly used in the art.

The polynucleotides identified as SEQ ID NOS: 1–121 contain open reading frames ("ORFs"), or partial open reading frames, encoding polypeptides. Additionally, polynucleotides identified as SEQ ID NOS: 1–121 may contain non-coding sequences such as promoters and terminators that may be useful as control elements. Additionally, open reading frames encoding polypeptides may be identified in extended or full-length sequences corresponding to the sequences set out as SEQ ID NOS: 122–253. Open reading frames may be identified using techniques that are well known in the art. These techniques include, for example, analysis for the location of known start and stop codons, most likely reading frame identification based on codon frequencies, similarity to known bacterial expressed genes, etc. Tools and software suitable for ORF analysis include GeneWise (The Sanger Center, Wellcome Trust Genome Campus, Hinxton, Cambridge CB10 1SA, United Kingdom), Diogenes (Computational Biology Centers, University of Minnesota, Academic Health Center, UMHG Box 43 Minneapolis Minn. 55455), and GRAIL (Informatics Group, Oak Ridge National Laboratories, Oak Ridge, Tennessee, Tenn.). Open reading frames and portions of open reading frames may be identified in the polynucleotides of the present invention. Once a partial open reading frame is identified, the polynucleotide may be extended in the area of the partial open reading frame using techniques that are well known in the art until the polynucleotide for the full open reading frame is identified. Thus, polynucleotides and open reading frames encoding polypeptides may be identified using the polynucleotides of the present invention.

Once open reading frames are identified in the polynucleotides of the present invention, the open reading frames may be isolated and/or synthesized. Expressible genetic constructs comprising the open reading frames and suitable promoters, initiators, terminators, etc., which are well known in the art, may then be constructed. Such genetic constructs may be introduced into a host cell to express the polypeptide encoded by the open reading frame. Suitable host cells may include various prokaryotic and eukaryotic cells. In vitro expression of polypeptides is also possible, as well known in the art.

As used herein, the term "oligonucleotide" refers to a relatively short segment of a polynucleotide sequence, generally comprising between 6 and 60 nucleotides, and comprehends both probes for use in hybridization assays and primers for use in the amplification of DNA by polymerase chain reaction.

As used herein, the term "x-mer," with reference to a specific value of "x," refers to a polynucleotide comprising at least a specified number ("x") of contiguous residues of any of the polynucleotides identified as SEQ ID NOS: 1–121. The value of x may be from about 20 to about 600, depending upon the specific sequence.

In another aspect, the present invention provides isolated polypeptides encoded, or partially encoded, by the above polynucleotides. In specific embodiments, such polypeptides comprise a sequence selected from the group consisting of SEQ ID NO: 122–253, and variants thereof. As used herein, the term "polypeptide" encompasses amino acid chains of any length, including full-length proteins, wherein the amino acid residues are linked by covalent peptide bonds. The term "polypeptide encoded by a polynucleotide" as used herein, includes polypeptides encoded by a polynucleotide which comprises an isolated polynucleotide sequence or variant provided herein. Polypeptides of the present invention may be naturally purified products, or may be produced partially or wholly using recombinant techniques. Such polypeptides may be glycosylated with bacterial, fungal, mammalian or other eukaryotic carbohydrates or may be non-glycosylated.

Polypeptides of the present invention may be produced recombinantly by inserting a polynucleotide that encodes the polypeptide into an expression vector and expressing the polypeptide in an appropriate host. Any of a variety of expression vectors known to those of ordinary skill in the art may be employed. Expression may be achieved in any appropriate host cell that has been transformed or transfected with an expression vector containing a polypeptide encoding a recombinant polypeptide. Suitable host cells include prokaryotes, yeast and higher eukaryotic cells. Preferably, the host cells employed are *Escherichia coli, Lactococcus lactis, Lactobacillus*, insect, yeast or a mammalian cell line such as COS or CHO. The polynucleotide(s) expressed in this manner may encode naturally occurring polypeptides, portions of naturally occurring polypeptides, or other variants thereof.

In a related aspect, polypeptides are provided that comprise at least a functional portion of a polypeptide having an amino acid sequence encoded by a polynucleotide of the present invention. As used herein, a "functional portion" of a polypeptide is that portion which contains the active site essential for affecting the function of the polypeptide, for example, the portion of the molecule that is capable of binding one or more reactants. The active site may be made up of separate portions present on one or more polypeptide chains and will generally exhibit high binding affinity.

Functional portions of a polypeptide may be identified by first preparing fragments of the polypeptide by either chemical or enzymatic digestion of the polypeptide, or by mutation analysis of the polynucleotide that encodes the polypeptide and subsequent expression of the resulting mutant polypeptides. The polypeptide fragments or mutant polypeptides are then tested to determine which portions retain biological activity, using, for example, the representative assays provided below.

Portions and other variants of the inventive polypeptides may be generated by synthetic or recombinant means. Synthetic polypeptides having fewer than about 100 amino acids, and generally fewer than about 50 amino acids, may be generated using techniques that are well known to those of ordinary skill in the art. For example, such polypeptides may be synthesized using any of the commercially available solid-phase techniques, such as the Merrifield solid-phase synthesis method, where amino acids are sequentially added to a growing amino acid chain (See Merrifield, *J. Am. Chem. Soc.* 85:2149–2154, 1963). Equipment for automated synthesis of polypeptides is commercially available from suppliers such as Perkin Elmer/Applied Biosystems, Inc. (Foster City, Calif.), and may be operated according to the manufacturer's instructions. Variants of a native polypeptide may be prepared using standard mutagenesis techniques, such as oligonucleotide-directed site-specific mutagenesis (Kunkel, *Proc. Natl. Acad. Sci. USA* 82: 488–492, 1985). Sections of DNA sequences may also be removed using standard techniques to permit preparation of truncated polypeptides.

In general, the polypeptides disclosed herein are prepared in an isolated, substantially pure form. Preferably, the polypeptides are at least about 80% pure; more preferably at least about 90% pure; and most preferably at least about 99% pure.

As used herein, the term "variant" comprehends polynucleotide or polypeptide sequences different from the specifically identified sequences, wherein one or more nucleotides or amino acid residues is deleted, substituted, or added. Variants may be naturally occurring allelic variants, or non-naturally occurring variants. Variant polynucleotide sequences preferably exhibit at least 60%, more preferably at least 75%, more preferably yet at least 90%, and most preferably at least 95% identity to a sequence of the present invention. Variant polypeptide sequences preferably exhibit at least 60%, more preferably at least 75%, more preferably yet at least 90%, and most preferably at least 95% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100.

Polynucleotide and polypeptide sequences may be aligned, and the percentage of identical residues in a specified region may be determined against another polynucleotide or polypeptide, using computer algorithms that are publicly available. Two exemplary algorithms for aligning and identifying the similarity of polynucleotide sequences are the BLASTN and FASTA algorithms. Polynucleotides may also be analyzed using the BLASTX algorithm, which compares the six-frame conceptual translation products of a nucleotide query sequence (both strands) against a protein sequence database. The percentage identity of polypeptide sequences may be examined using the BLASTP algorithm. The BLASTN, BLASTX and BLASTP programs are available on the NCBI anonymous FTP server and from the National Center for Biotechnology Information (NCBI), National Library of Medicine, Building 38A, Room 8N805, Bethesda, Md. 20894, USA. The BLASTN algorithm Version 2.0.4 [Feb. 24, 1998], Version 2.0.6 [Sep. 16, 1998] and Version 2.0.11 [Jan. 20, 2000], set to the parameters described below, is preferred for use in the determination of polynucleotide variants according to the present invention. The BLASTP algorithm, set to the parameters described below, is preferred for use in the determination of polypeptide variants according to the present invention. The use of the BLAST family of algorithms, including BLASTN, BLASTP and BLASTX, is described in the publication of Altschul, et al., *Nucleic Acids Res.* 25: 3389–3402, 1997.

The computer algorithm FASTA is available on the Internet and from the University of Virginia by contacting David Hudson, Vice Provost for Research, University of Virginia, P.O. Box 9025, Charlottesville, Va. 22906–9025, USA. FASTA Version 2.0u4 [February 1996], set to the default parameters described in the documentation and distributed with the algorithm, may be used in the determination of variants according to the present invention. The use of the FASTA algorithm is described in Pearson and Lipman, *Proc. Natl. Acad. Sci. USA* 85:2444–2448, 1988; and Pearson, *Methods in Enzymol.* 183: 63–98, 1990.

The following running parameters are preferred for determination of alignments and similarities using BLASTN that contribute to the E values and percentage identity for polynucleotide sequences: Unix running command: blastall -p blastn -d embldb -e 10 -G0 -E0 -r 1 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (BLASTN only) [Integer]; -v Number of one-line descriptions (V) [Integer]; -b Number of alignments to show (B) [Integer]; -i Query File [File In]; and -o BLAST report Output File [File Out] Optional.

The following running parameters are preferred for determination of alignments and similarities using BLASTP that contribute to the E values and percentage identity of polypeptide sequences: blastall -p blastp -d swissprotdb -e 10 -G 0 -E 0 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional. The "hits" to one or more database sequences by a queried sequence produced by BLASTN, FASTA, BLASTP or a similar algorithm, align and identify similar portions of sequences. The hits are arranged in order of the degree of similarity and the length of sequence overlap. Hits to a database sequence generally represent an overlap over only a fraction of the sequence length of the queried sequence.

The BLASTN, FASTA, and BLASTP algorithms also produce "Expect" values for alignments. The Expect value (E) indicates the number of hits one can "expect" to see over a certain number of contiguous sequences by chance when searching a database of a certain size. The Expect value is used as a significance threshold for determining whether the hit to a database, such as the preferred EMBL database, indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the polynucleotide sequences then have a probability of 90% of being the same. For sequences having an E value of 0.01 or less over aligned and matched portions, the probability of finding a match by chance in the EMBL database is 1% or less using the BLASTN or FASTA algorithm.

According to one embodiment, "variant" polynucleotides and polypeptides, with reference to each of the polynucleotides and polypeptides of the present invention, preferably comprise sequences producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described above. According to a preferred embodiment, a variant polynucleotide is a sequence having the same number or fewer nucleic acids than a polynucleotide of the present invention that has at least a 99% probability of being the same as the polynucleotide of the present invention, measured as having an E value of 0.01 or less using the BLASTN or FASTA algorithms set at parameters described above. Similarly, according to a preferred embodiment, a variant polypeptide is a sequence having the same number or fewer amino acids than a polypeptide of the present invention that has at least a 99% probability of being the same as a polypeptide of the present invention, measured as having an E value of 0.01 or less using the BLASTP algorithm set at the parameters described above.

As noted above, the percentage identity is determined by aligning sequences using one of the BLASTN, FASTA, or BLASTP algorithms, set at the running parameters described above, and identifying the number of identical nucleic or amino acids over the aligned portions; dividing the number of identical nucleic or amino acids by the total number of nucleic or amino acids of the polynucleotide or polypeptide sequence of the present invention; and then multiplying by 100 to determine the percentage identity. For example, a polynucleotide of the present invention having 220 nucleic acids has a hit to a polynucleotide sequence in the EMBL database having 520 nucleic acids over a stretch of 23 nucleotides in the alignment produced by the BLASTN algorithm using the parameters described above. The 23 nucleotide hit includes 21 identical nucleotides, one gap and one different nucleotide. The percentage identity of the polynucleotide of the present invention to the hit in the EMBL library is thus 21/220 times 100, or 9.5%. The polynucleotide sequence in the EMBL database is thus not a variant of a polynucleotide of the present invention.

In addition to having a specified percentage identity to an inventive polynucleotide or polypeptide sequence, variant polynucleotides and polypeptides preferably have additional structure and/or functional features in common with the inventive polynucleotide or polypeptide. Polypeptides having a specified degree of identity to a polypeptide of the present invention share a high degree of similarity in their primary structure and have substantially similar functional properties. In addition to sharing a high degree of similarity in their primary structure to polynucleotides of the present invention, polynucleotides having a specified degree of identity to, or capable of hybridizing to an inventive polynucleotide preferably have at least one of the following features: (i) they contain an open reading frame or partial open reading frame encoding a polypeptide having substantially the same functional properties as the polypeptide encoded by the inventive polynucleotide; or (ii) they contain identifiable domains in common.

Alternatively, variant polynucleotides of the present invention hybridize to the polynucleotide sequences recited in SEQ ID NOS: 1–121, or complements, reverse sequences, or reverse complements of those sequences under stringent conditions. As used herein, "stringent conditions" refers to prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

The present invention also encompasses polynucleotides that differ from the disclosed sequences but that, as a consequence of the discrepancy of the genetic code, encode a polypeptide having similar enzymatic activity as a polypeptide encoded by a polynucleotide of the present invention. Thus, polynucleotides comprising sequences that differ from the polynucleotide sequences recited in SEQ ID NOS: 1–121, or complements, reverse sequences, or reverse complements of those sequences as a result of conservative substitutions are encompassed within the present invention. Additionally, polynucleotides comprising sequences that differ from the inventive polynucleotide sequences or complements, reverse complements, or reverse sequences as a result of deletions and/or insertions totaling less than 10% of the total sequence length are also contemplated by and encompassed within the present invention. Similarly, polypeptides comprising sequences that differ from the inventive polypeptide sequences as a result of amino acid substitutions, insertions, and/or deletions totaling less than 10% of the total sequence length are contemplated by and encompassed within the present invention, provided the variant polypeptide has similar activity to the inventive polypeptide.

The polynucleotides of the present invention may be isolated from various libraries, or may be synthesized using techniques that are well known in the art. The polynucleotides may be synthesized, for example, using automated oligonucleotide synthesizers (e.g., Beckman Oligo 1000M DNA Synthesizer) to obtain polynucleotide segments of up to 50 or more nucleic acids. A plurality of such polynucleotide segments may then be ligated using standard DNA manipulation techniques that are well known in the art of molecular biology. One conventional and exemplary polynucleotide synthesis technique involves synthesis of a single stranded polynucleotide segment having, for example, 80 nucleic acids, and hybridizing that segment to a synthesized complementary 85 nucleic acid segment to produce a 5-nucleotide overhang. The next segment may then be synthesized in a similar fashion, with a 5-nucleotide overhang on the opposite strand. The "sticky" ends ensure proper ligation when the two portions are hybridized. In this way, a complete polynucleotide of the present invention may be synthesized entirely in vitro.

Certain of the polynucleotides identified as SEQ ID NOS: 1–121 are generally referred to as "partial" sequences, in that they may not represent the full coding portion of a gene encoding a naturally occurring polypeptide. The partial polynucleotide sequences disclosed herein may be employed to obtain the corresponding full-length genes for various species and organisms by, for example, screening DNA expression libraries using hybridization probes based on the polynucleotides of the present invention, or using PCR amplification with primers based upon the polynucleotides of the present invention. In this way one can, using methods well known in the art, extend a polynucleotide of the present invention upstream and downstream of the corresponding DNA, as well as identify the corresponding MRNA and genomic DNA, including the promoter and enhancer regions, of the complete gene. The present invention thus comprehends isolated polynucleotides comprising a sequence identified in SEQ ID NOS: 1–121, or a variant of one of the specified sequences, that encode a functional polypeptide, including full-length genes. Such extended polynucleotides may have a length of from about 50 to about 4,000 nucleic acids or base pairs, and preferably have a length of less than about 4,000 nucleic acids or base pairs, more preferably yet a length of less than about 3,000 nucleic acids or base pairs, more preferably yet a length of less than about 2,000 nucleic acids or base pairs. Under some circumstances, extended polynucleotides of the present invention may have a length of less than about 1,800 nucleic acids or base pairs, preferably less than about 1,600 nucleic acids or base pairs, more preferably less than about 1,400 nucleic acids or base pairs, more preferably yet less than about 1,200 nucleic acids or base pairs, and most preferably less than about 1,000 nucleic acids or base pairs.

Polynucleotides of the present invention comprehend polynucleotides comprising at least a specified number of contiguous residues (x-mers) of any of the polynucleotides identified as SEQ ID NOS: 1–121 or their variants. According to preferred embodiments, the value of x is preferably at least 20, more preferably at least 40, more preferably yet at least 60, and most preferably at least 80. Thus, polynucleotides of the present invention include polynucleotides comprising a 20-mer, a 40-mer, a 60-mer, an 80-mer, a 100-mer, a 120-mer, a 150-mer, a 180-mer, a 220-mer a 250-mer, or a 300-mer, 400-mer, 500-mer or 600-mer of a polynucleotide identified as SEQ ID NOS: 1–121 or a variant of one of the polynucleotides identified as SEQ ID NOS: 1–121.

Oligonucleotide probes and primers complementary to and/or corresponding to SEQ ID NOS: 1–121, and variants of those sequences, are also comprehended by the present invention. Such oligonucleotide probes and primers are substantially complementary to the polynucleotide of interest. An oligonucleotide probe or primer is described as "corresponding to" a polynucleotide of the present invention, including one of the sequences set out as SEQ ID NOS: 1–121 or a variant, if the oligonucleotide probe or primer, or its complement, is contained within one of the sequences set out as SEQ ID NOS: 1–121 or a variant of one of the specified sequences.

Two single stranded sequences are said to be substantially complementary when the nucleotides of one strand, optimally aligned and compared, with the appropriate nucleotide insertions and/or deletions, pair with at least 80%, preferably at least 90% to 95%, and more preferably at least 98% to 100%, of the nucleotides of the other strand. Alternatively, substantial complementarity exists when a first DNA strand will selectively hybridize to a second DNA strand under stringent hybridization conditions. Stringent hybridization conditions for determining complementarity include salt conditions of less than about 1 M, more usually less than about 500 mM and preferably less than about 200 mM. Hybridization temperatures can be as low as 5° C., but are generally greater than about 22° C., more preferably greater than about 30° C. and most preferably greater than about 37° C. Longer DNA fragments may require higher hybridization temperatures for specific hybridization. Since the stringency of hybridization may be affected by other factors such as probe composition, presence of organic solvents and extent of base mismatching, the combination of parameters is more important than the absolute measure of any one alone. DNA-DNA hybridization studies may performed using either genomic DNA or DNA derived by preparing cDNA from the RNA present in a sample to be tested.

In addition to DNA-DNA hybridization, DNA-RNA or RNA-RNA hybridization assays are also possible. In the first case, the mRNA from expressed genes would then be detected instead of genomic DNA or cDNA derived from MRNA of the sample. In the second case, RNA probes could be used. In addition, artificial analogs of DNA hybridizing specifically to target sequences could also be used.

In specific embodiments, the oligonucleotide probes and/or primers comprise at least about 6 contiguous residues, more preferably at least about 10 contiguous residues, and most preferably at least about 20 contiguous residues complementary to a polynucleotide sequence of the present invention. Probes and primers of the present invention may be from about 8 to 100 base pairs in length or, preferably from about 10 to 50 base pairs in length or, more preferably from about 15 to 40 base pairs in length. The primers and probes may be readily selected using procedures well known in the art, taking into account DNA-DNA hybridization stringencies, annealing and melting temperatures, potential for formation of loops and other factors, which are well known in the art. Tools and software suitable for designing probes, and especially for designing PCR primers, are available from Premier Biosoft International, 3786 Corina Way, Palo Alto, Calif. 94303-4504. Preferred techniques for designing PCR primers are also disclosed in Dieffenbach and Dyksler, *PCR primer: a laboratory manual*, CSHL Press: Cold Spring Harbor, N.Y., 1995.

A plurality of oligonucleotide probes or primers corresponding to a polynucleotide of the present invention may be provided in a kit form. Such kits generally comprise multiple DNA or oligonucleotide probes, each probe being specific for a polynucleotide sequence. Kits of the present invention may comprise one or more probes or primers corresponding to a polynucleotide of the present invention, including a polynucleotide sequence identified in SEQ ID NOS: 1–121.

In one embodiment useful for high-throughput assays, the oligonucleotide probe kits of the present invention comprise multiple probes in an array format, wherein each probe is immobilized in a predefined, spatially addressable location on the surface of a solid substrate. Array formats which may be usefully employed in the present invention are disclosed, for example, in U.S. Pat. Nos. 5,412,087, 5,545,531, and PCT Publication No. WO 95/00530, the disclosures of which are hereby incorporated by reference.

Oligonucleotide probes for use in the present invention may be constructed synthetically prior to immobilization on an array, using techniques well known in the art (See, for example, Gait, ed., *Oligonucleotide synthesis a practical approach*, IRL Press: Oxford, England, 1984). Automated equipment for the synthesis of oligonucleotides is available commercially from such companies as Perkin Elmer/Applied Biosystems Division (Foster City, Calif.) and may be operated according to the manufacturer's instructions. Alternatively, the probes may be constructed directly on the surface of the array using techniques taught, for example, in PCT Publication No. WO 95/00530.

The solid substrate and the surface thereof preferably form a rigid support and are generally formed from the same material. Examples of materials from which the solid substrate may be constructed include polymers, plastics, resins, membranes, polysaccharides, silica or silica-based materials, carbon, metals and inorganic glasses. Synthetically prepared probes may be immobilized on the surface of the solid substrate using techniques well known in the art, such as those disclosed in U.S. Pat. No. 5,412,087.

In one such technique, compounds having protected functional groups, such as thiols protected with photochemically removable protecting groups, are attached to the surface of the substrate. Selected regions of the surface are then irradiated with a light source, preferably a laser, to provide reactive thiol groups. This irradiation step is generally performed using a mask having apertures at predefined locations using photolithographic techniques well known in the art of semiconductors. The reactive thiol groups are then incubated with the oligonucleotide probe to be immobilized. The precise conditions for incubation, such as temperature, time and pH, depend on the specific probe and can be easily determined by one of skill in the art. The surface of the substrate is washed free of unbound probe and the irradiation step is repeated using a second mask having a different pattern of apertures. The surface is subsequently incubated with a second, different, probe. Each oligonucleotide probe is typically immobilized in a discrete area of less than about 1 mm$^2$. Preferably each discrete area is less than about 10,000 mm$^2$, more preferably less than about 100 mm$^2$. In this manner, a multitude of oligonucleotide probes may be immobilized at predefined locations on the array.

The resulting array may be employed to screen for differences in organisms or samples or products containing genetic material as follows. Genomic or cDNA libraries are prepared using techniques well known in the art. The resulting target DNA is then labeled with a suitable marker, such as a radiolabel, chromophore, fluorophore or chemiluminescent agent, using protocols well known for those skilled in the art. A solution of the labeled target DNA is contacted with the surface of the array and incubated for a suitable period of time.

The surface of the array is then washed free of unbound target DNA and the probes to which the target DNA hybridized are determined by identifying those regions of the array to which the markers are attached. When the marker is a radiolabel, such as $^{32}$P, autoradiography is employed as the detection method. In one embodiment, the marker is a fluorophore, such as fluorescein, and the location of bound target DNA is determined by means of fluorescence spectroscopy. Automated equipment for use in fluorescence scanning of oligonucleotide probe arrays is available from Affymetrix, Inc. (Santa Clara, Calif.) and may be operated according to the manufacturer's instructions. Such equipment may be employed to determine the intensity of fluorescence at each predefined location on the array, thereby providing a measure of the amount of target DNA bound at each location. Such an assay would be able to indicate not only the absence and presence of the marker probe in the target, but also the quantitative amount as well.

The significance of such high-throughput screening system is apparent for applications such as microbial selection and quality control operations in which there is a need to identify large numbers of samples or products for unwanted materials, to identify microbes or samples or products containing microbial material for quarantine purposes, etc., or to ascertain the true origin of samples or products containing microbes. Screening for the presence or absence of polynucleotides of the present invention used as identifiers for tagging microbes and microbial products can be valuable for later detecting the genetic composition of food, fermentation and industrial microbes or microbes in human or animal digestive system after consumption of probiotics, etc.

In this manner, oligonucleotide probe kits of the present invention may be employed to examine the presence/absence (or relative amounts in case of mixtures) of polynucleotides in different samples or products containing different materials rapidly and in a cost-effective manner. Examples of microbial species which may be examined using the present invention, include lactic acid bacteria, such as *Lactobacillus rhamnosus*, and other microbial species.

Another aspect of the present invention involves collections of a plurality of polynucleotides of the present invention. A collection of a plurality of the polynucleotides of the present invention, particularly the polynucleotides identified as SEQ ID NOS: 1–121, may be recorded and/or stored on a storage medium and subsequently accessed for purposes of analysis, comparison, etc. Suitable storage media include magnetic media such as magnetic diskettes, magnetic tapes, CD-ROM storage media, optical storage media, and the like. Suitable storage media and methods for recording and storing information, as well as accessing information such as polynucleotide sequences recorded on such media, are well known in the art. The polynucleotide information stored on the storage medium is preferably computer-readable and may be used for analysis and comparison of the polynucleotide information.

Another aspect of the present invention thus involves storage medium on which are recorded a collection of the polynucleotides of the present invention, particularly a collection of the polynucleotides identified as SEQ ID NOS: 1–121. According to one embodiment, the storage medium includes a collection of at least 20, preferably at least 50, more preferably at least 100, and most preferably at least 200 of the polynucleotides of the present invention, preferably the polynucleotides identified as SEQ ID NOS: 1–121, including variants of those polynucleotides.

Another aspect of the present invention involves a combination of polynucleotides, the combination containing at least 5, preferably at least 10, more preferably at least 20, and most preferably at least 50 different polynucleotides of the present invention, including polynucleotides selected from SEQ ID NOS: 1–121, and variants of these polynucleotides.

In another aspect, the present invention provides genetic constructs comprising, in the 5'–3' direction, a gene promoter sequence and an open reading frame coding for at least a functional portion of a polypeptide encoded by a polynucleotide of the present invention. In certain embodiments, the genetic constructs of the present invention also comprise a gene termination sequence. The open reading frame may be oriented in either a sense or antisense direction. Genetic constructs comprising a non-coding region of a gene coding for a polypeptide encoded by an inventive polynucleotide or a nucleotide sequence complementary to a non-coding region, together with a gene promoter sequence, are also provided. A terminator sequence may form part of this construct. Preferably, the gene promoter and termination sequences are functional in a host organism. More preferably, the gene promoter and termination sequences are common to those of the polynucleotide being introduced. The genetic construct may further include a marker for the identification of transformed cells.

Techniques for operatively linking the components of the genetic constructs are well known in the art and include the use of synthetic linkers containing one or more restriction endonuclease sites as described, for example, by Sambrook et al., in *Molecular cloning: a laboratory manual*, Cold Spring Harbor Laboratories Press: Cold Spring Harbor, N.Y., 1989. The genetic constructs of the present invention may be linked to a vector having at least one replication system, for example, *E. coli*, whereby after each manipulation, the resulting construct can be cloned and sequenced and the correctness of the manipulation determined.

Transgenic microbial cells comprising the genetic constructs of the present invention are also provided by the present invention, together with microbes comprising such transgenic cells, products and progeny of such microbes, and materials including such microbes. Techniques for stably incorporating genetic constructs into the genome of target microbes, such as *Lactobacillus* species, *Lactococcus lactis* or *E. coli*, are well known in the art of bacterial transformation and are exemplified by the transformation of *E. coli* for sequencing described in Example 1.

Transgenic non-microbial cells comprising the genetic constructs of the present invention are also provided, together with organisms comprising such transgenic cells, and products and progeny of such organisms. Genetic constructs of the present invention may be stably incorporated into the genomes of non-microbial target organisms, such as fungi, using techniques well known in the art.

In preferred embodiments, the genetic constructs of the present invention are employed to transform microbes used in the production of food products, ingredients, processing aids, additives or supplements and for the production of microbial products for pharmaceutical uses, particularly for modulating immune system function and immunological effects, and in the production of chemoprotectants providing beneficial effects, probiotics and health supplements. The inventive genetic constructs may also be employed to transform bacteria that are used to produce enzymes or substances such as polysaccharides, flavor compounds and bioactive substances, and to enhance resistance to industrial processes such as drying and to adverse stimuli in the human digestive system. The genes involved in antibiotic production, and phage uptake and resistance in *Lactobacillus rhamnosus* are considered to be especially useful. The target microbe to be used for transformation with one or more polynucleotides or genetic constructs of the present invention is preferably selected from the group consisting of bacterial genera *Lactococcus, Lactobacillus, Streptococcus, Oenococcus, Lactosphaera, Trichococcus, Pediococcus* and others potentially useful in various fermentation industries and is most preferably selected from the group consisting of the following *Lactobacillus* species: *Lactobacillus acetotol-* erans, *Lactobacillus acidophilus*, *Lactobacillus agilis*, *Lactobacillus alimentarius*, *Lactobacillus amylolyticus*, *Lactobacillus amylophilus*, *Lactobacillus amylovorus*, *Lactobacillus animalis*, *Lactobacillus arizonae*, *Lactobacillus aviarius*, *Lactobacillus bavaricus*, *Lactobacillus bifermentans*, *Lactobacillus brevis*, *Lactobacillus buchneri*, *Lactobacillus bulgaricus*, *Lactobacillus casei*, *Lactobacillus collinoides*, *Lactobacillus coryniformis*, *Lactobacillus crispatus*, *Lactobacillus curvatus*, *Lactobacillus delbrueckii*, *Lactobacillus delbrueckii* subsp. *bulgaricus*, *Lactobacillus delbrueckii* subsp. *lactis*, *Lactobacillus farciminis*, *Lactobacillus fermentum*, *Lactobacillus fructivorans*, *Lactobacillus gallinarum*, *Lactobacillus gasseri*, *Lactobacillus graminis*, *Lactobacillus hamsteri*, *Lactobacillus helveticus*, *Lactobacillus helveticus* subsp. *jugurti*, *Lactobacillus hetero*, *Lactobacillus hilgardii*, *Lactobacillus homohiochii*, *Lactobacillus japonicus*, *Lactobacillus johnsonii*, *Lactobacillus kefiri*, *Lactobacillus lactis*, *Lactobacillus leichmannii*, *Lactobacillus lindneri*, *Lactobacillus mali*, *Lactobacillus maltaromicus*, *Lactobacillus manihotivorans*, *Lactobacillus mucosae*, *Lactobacillus murinus*, *Lactobacillus oris*, *Lactobacillus panis*, *Lactobacillus paracasei*, *Lactobacillus paracasei* subsp. *pseudoplantarum*, *Lactobacillus paraplantarum*, *Lactobacillus pentosus*, *Lactobacillus plantarum*, *Lactobacillus pontis*, *Lactobacillus reuteri*, *Lactobacillus rhamnosus*, *Lactobacillus ruminis*, *Lactobacillus sake*, *Lactobacillus salivarius*, *Lactobacillus salivarius* subsp. *salicinius*, *Lactobacillus salivarius* subsp. *salivarius*, *Lactobacillus sanfranciscensis*, *Lactobacillus sharpeae*, *Lactobacillus thermophilus*, *Lactobacillus vaginalis*, *Lactobacillus vermiforme*, and *Lactobacillus zeae*.

In yet a further aspect, the present invention provides methods for modifying the concentration, composition and/or activity of a polypeptide in a host organism, such as a microbe, comprising stably incorporating a genetic construct of the present invention into the genome of the host organism by transforming the host organism with such a genetic construct. The genetic constructs of the present invention may be used to transform a variety of organisms including plants, such as monocotyledonous angiosperms (e.g., grasses, corn, grains, oat, wheat and barley); dicotyledonous angiosperms (e.g., *Arabidopsis*, tobacco, legumes, alfalfa, oaks, eucalyptus, maple); gymnosperms, (e.g., Scots pine (Aronen, *Finnish Forest Res. Papers*, Vol. 595, 1996); white spruce (Ellis et al., *Biotechnology* 11:84–89, 1993); larch (Huang et al., *In Vitro Cell* 27:201–207, 1991); and any kind of plant amenable to genetic engineering.

Thus, in yet another aspect, transgenic plant cells comprising the genetic constructs of the present invention are provided, together with plants comprising such transgenic cells, and fruits, seeds, products and progeny of such plants. Techniques for stably incorporating genetic constructs into the genome of target organisms, such as plants, are well known in the art and include *Agrobacterium tumefaciens* mediated introduction, electroporation, protoplast fusion, injection into reproductive organs, injection into immature embryos, high velocity projectile introduction and the like. The choice of technique will depend upon the target plant to be transformed. For example, dicotyledonous plants, and certain monocots and gymnosperms, may be transformed by *Agrobacterium* Ti plasmid technology, as described, for example by Bevan, *Nucleic Acids Res.* 12:8711–8721, 1984. Targets for the introduction of the genetic constructs include tissues, such as leaf tissue, disseminated cells, protoplasts, seeds, embryos, meristematic regions, cotyledons, hypocotyls, and the like.

Once the cells are transformed, cells having the genetic construct incorporated in their genome are selected. Transgenic cells may then be cultured in an appropriate medium, using techniques well known in the art. In the case of protoplasts, the cell wall is allowed to reform under appropriate osmotic conditions. In the case of seeds or embryos, an appropriate germination or callus initiation medium is employed. For explants, an appropriate regeneration medium is used. Regeneration of plants is well established for many species. For a review of regeneration of forest trees, see Dunstan et al., "Somatic embryogenesis in woody plants," in Thorpe, T. A., ed., *In vitro embryogenesis of plants*, (*Current Plant Science and Biotechnology in Agriculture*), 20(12):471–540, 1995. Specific protocols for the regeneration of spruce are discussed by Roberts et al. ("Somatic embryogenesis of Spruce," in Redenbaugh K., ed., *Synseed. applications of synthetic seed to crop improvement*, CRC Press: Ch.23:427–449, 1993). The resulting transformed plants may be reproduced sexually or asexually, using methods well known in the art, to give successive generations of transgenic plants and practically unlimited amounts of tagged plant-derived products.

The polynucleotides of the present invention may be further employed as non-disruptive tags for marking organisms, particularly microbes. Other organisms may, however, be tagged with the polynucleotides of the present invention, including commercially valuable plants, animals, fish, fungi and yeasts. Genetic constructs comprising polynucleotides of the present invention may be stably introduced into an organism as heterologous, non-functional, non-disruptive tags. It is then possible to identify the origin or source of the organism at a later date by determining the presence or absence of the tag(s) in a sample of material. Detection of the tag(s) may be accomplished using a variety of conventional techniques, and will generally involve the use of nucleic acid probes. Sensitivity in assaying the presence of probe can be usefully increased by using branched oligonucleotides, as described by Horn et al., *Nucleic Acids Res.* 25(23):4842–4849, 1997, enabling detection of as few as 50 DNA molecules in the sample.

Polynucleotides of the present invention may also be used to spacifically suppress gene expression by methods that operate post-transcriptionally to block the synthesis of products of targeted genes, such as RNA interference (RNAi), and quelling. Briefly, traditional methods of gene suppression, employing anti-sense RNA or DNA, operate by binding to the reverse sequence of a gene of interest such that binding interferes with subsequent cellular processes and therefore blocks synthesis of the corresponding protein. RNAi also operates on a post-translational level and is sequence specific, but suppresses gene expression far more efficiently. Exemplary methods for controlling or modifying gene expression using RNAi are provided in WO 99/49029 and WO 99/53050. In these methods, post-transcriptional gene silencing is brought about by a sequence-specific RNA degradation process which results in the rapid degradation of transcripts of sequence-related genes. Studies have shown that double-stranded RNA may act as a mediator of sequence-specific gene silencing (see, for example, Montgomery and Fire, *Trends in Genetics*, 14:255–258, 1998). Gene constructs that produce transcripts with self-complementary regions are particularly efficient at gene silencing. A unique feature of this post-transcriptional gene silencing pathway is that silencing is not limited to the cells where it is initiated. The gene-silencing effects may be disseminated to other parts of an organism and even transmitted through the germ line to several generations.

The polynucleotides of the present invention may thus be employed to generate gene silencing constructs and/or gene-specific self-complementary RNA sequences that can be delivered by conventional art-known methods to cells, such as microbial cells. Within genetic constructs, sense and antisense sequences can be placed in regions flanking an intron sequence in proper splicing orientation with donor and acceptor splicing sites, such that intron sequences are removed during processing of the transcript and sense and antisense sequences, as well as splice junction sequences, bind together to form double-stranded RNA. Alternatively, spacer sequences of various lengths may be employed to separate self-complementary regions of sequence in the construct. During processing of the gene construct transcript, intron sequences are spliced-out, allowing sense and anti-sense sequences, as well as splice junction sequences, to bind forming double-stranded RNA. Select ribonucleases then bind to and cleave the double-stranded RNA, thereby initiating the cascade of events leading to degradation of specific mRNA gene sequences, and silencing specific genes. Alternatively, rather than using a gene construct to express the self-complementary RNA sequences, the gene-specific double-stranded RNA segments are delivered to one or more targeted areas to be internalized into the cell cytoplasm to exert a gene silencing effect. The double-stranded RNA must have sufficient homology to the targeted gene to mediate RNAi and is preferably at least 25 nucleotides in length. Preferably, the double-stranded RNA corresponds specifically to a polynucleotide of the present invention. Gene silencing RNA sequences comprising the polynucleotides of the present invention are useful for creating genetically modified organisms with desired phenotypes as well as for characterizing genes (for example, in high-throughput screening of sequences), and studying their functions in intact organisms.

In another aspect, the present invention provides methods for using one or more of the inventive polypeptides or polynucleotides to treat disorders in a mammal, such as a human.

In this aspect, the polypeptide or polynucleotide is generally present within a composition, such as a pharmaceutical or immunogenic composition. Pharmaceutical compositions may comprise one or more polypeptides, each of which may contain one or more of the above sequences (or variants thereof), and a physiologically acceptable carrier. Immunogenic compositions may comprise one or more of the above polypeptides and an immunostimulant, such as an adjuvant or a liposome, into which the polypeptide is incorporated.

Alternatively, a composition of the present invention may contain DNA encoding one or more polypeptides described herein, such that the polypeptide is generated in situ. In such compositions, the DNA may be present within any of a variety of delivery systems known to those of ordinary skill in the art, including nucleic acid expression systems, and bacterial and viral expression systems. Appropriate nucleic acid expression systems contain the necessary DNA sequences for expression in the patient (such as a suitable promoter and terminator signal). Bacterial delivery systems involve the administration of a bacterium (such as Bacillus Calmette-Guerin) that expresses an immunogenic portion of the polypeptide on its cell surface. In a preferred embodiment, the DNA may be introduced using a viral expression system (e.g., vaccinia or other poxvirus, retrovirus, or adenovirus), which may involve the use of a non-pathogenic, or defective, replication competent virus. Techniques for incorporating DNA into such expression systems are well known in the art. The DNA may also be "naked," as described, for example, in Ulmer et al., Science 259:1745–1749, 1993 and reviewed by Cohen, Science 259:1691–1692, 1993. The uptake of naked DNA may be increased by coating the DNA onto biodegradable beads, which are efficiently transported into the cells.

While any suitable carrier known to those of ordinary skill in the art may be employed in the pharmaceutical compositions of this invention, the type of carrier will vary depending on the mode of administration. For parenteral administration, such as subcutaneous injection, the carrier preferably comprises water, saline, alcohol, a lipid, a wax or a buffer. For oral administration, any of the above carriers or a solid carrier, such as mannitol, lactose, starch, magnesium stearate, sodium saccharine, talcum, cellulose, glucose, sucrose, and magnesium carbonate, may be employed. Biodegradable microspheres (e.g., polylactic galactide) may also be employed as carriers for the pharmaceutical compositions of this invention. Suitable biodegradable microspheres are disclosed, for example, in U.S. Pat. Nos. 4,897,268 and 5,075,109.

Any of a variety of adjuvants may be employed in the immunogenic compositions of the present invention to non-specifically enhance an immune response. Most adjuvants contain a substance designed to protect the antigen from rapid catabolism, such as aluminum hydroxide or mineral oil, and a non-specific stimulator of immune responses, such as lipid A, *Bordetella pertussis* or *M. tuberculosis*. Suitable adjuvants are commercially available as, for example, Freund's Incomplete Adjuvant and Freund's Complete Adjuvant (Difco Laboratories, Detroit, Mich.), and Merck Adjuvant 65 (Merck and Company, Inc., Rahway, N.J.). Other suitable adjuvants include alum, biodegradable microspheres, monophosphoryl lipid A and Quil A.

Routes and frequency of administration, as well as dosage, vary from individual to individual. In general, the inventive compositions may be administered by injection (e.g., intradermal, intramuscular, intravenous or subcutaneous), intranasally (e.g., by aspiration) or orally. In general, the amount of polypeptide present in a dose (or produced in situ by the DNA in a dose) ranges from about 1 pg to about 100 mg per kg of host, typically from about 10 pg to about 1 mg per kg of host, and preferably from about 100 pg to about 1 μg per kg of host. Suitable dose sizes will vary with the size of the patient, but will typically range from about 0.1 ml to about 2 ml.

The following examples are offered by way of illustration and not by way of limitation.

EXAMPLE 1

Isolation and Characterization of DNA Sequence from *Lactobacillus Rhamnosus* Strain HN001

*Lactobacillus rhamnosus* strain HN001 DNA libraries were constructed and screened as follows.

DNA was prepared in large scale by cultivating the bacteria in 2×100 ml cultures with 100 ml MRS broth (Difco Laboratories, Detroit, Mich.) and 1 ml *Lactobacillus* glycerol stock as inoculum, placed into 500 ml culture flasks and incubated at 37° C. for approx. 16 hours with shaking (220 rpm).

The cultures were centrifuged at 3500 rpm for 10 min to pellet the cells. The supernatant was removed and the cell pellet resuspended in 40 ml fresh MRS broth and transferred to clean 500 ml culture flasks. Fresh MRS broth (60 ml) was added to bring the volume back to 100 ml and flasks were incubated for a further 2 hrs at 37° C. with shaking (220 rpm). The cells were pelleted by centrifugation (3500 rpm for 10 min) and supernatant removed. Cell pellets were washed twice in 20 ml buffer A (50 mM NaCl, 30 mM Tris pH 8.0, 0.5 mM EDTA).

Cells were resuspended in 2.5 ml buffer B (25% sucrose (w/v), 50 mM Tris pH 8.0, 1 mM EDTA, 20 mg/ml lysozyme, 20 μg/ml mutanolysin) and incubated at 37° C. for 45 min. Equal volumes of EDTA (0.25 M) was added to each tube and allowed to incubate at room temperature for 5 min. 20% SDS (1 ml) solution was added, mixed and incubated at 65° C. for 90 min. 50 μl Proteinase K (Gibco BRL, Gaithersburg, Md.) from a stock solution of 20 mg/ml was added and tubes incubated at 65° C. for 15 min.

DNA was extracted with equal volumes of phenol:chloroform:isoamylalcohol (25:24:1). Tubes were centrifuged at 3500 rpm for 40 min. The aqueous phase was removed to clean sterile Oak Ridge centrifuge tubes (30 ml). Crude DNA was precipitated with an equal volume of cold isopropanol and incubated at −20° C. overnight.

After resuspension in 500 μl TE buffer, DNase-free RNase was added to a final concentraion of 100 μg/ml and incubated at 37° C. for 30 min. The incubation was extended for a further 30 min after adding 100 μl Proteinase K from a stock solution of 20 mg/ml. DNA was precipitated with ethanol after a phenol:chloroform:isoamylalcohol (25:24:1) and a chloroform:isoamylalcohol (24:1) extraction and dissolved in 250 μl TE buffer.

DNA was digested with Sau3AI at a concentration of 0.004 U/μg in a total volume of 1480 μl, with 996 μl DNA, 138.75 μl 10×REACT 4 buffer and 252.75 μl H$_2$O. Following incubation for 1 hour at 37° C., DNA was divided into two tubes. 31 μl 0.5 M EDTA was added to stop the digestion and 17 μl samples were taken for agarose gel analysis. Samples were put into 15 ml Falcon tubes and diluted to 3 ml for loading onto sucrose gradient tubes.

Sucrose gradient size fractionation was conducted as follows. 100 ml of 50% sucrose (w/v) was made in TEN buffer (1M NaCl, 20 mM Tris pH 8.0, 5 mM EDTA) and sterile filtered. Dilutions of 5, 10, 15, 20, 25, 30, 35 and 40% sucrose were prepared and overlaid carefully in Beckman Polyallomer tubes, and kept overnight at 4° C. TEN buffer (4 ml) was loaded onto the gradient, with 3 ml of DNA solution on top. The gradients were centrifuged at 26K for 18 hours at 4° C. in a Centricon T-2060 centrifuge using a Kontron TST 28-38 rotor. After deceleration without braking (approx. 1 hour), the gradients were removed and fractions collected using an auto Densi-Flow (Haake-Buchler Instruments). Agarose gel was used to analyze the fractions. The best two pairs of fractions were pooled and diluted to contain less than 10% sucrose. TEN buffer (4 ml) was added and DNA precipitated with 2 volumes of 100% ice cold ethanol and an overnight incubation at −20° C.

DNA pellets were resuspended in 300 μl TE buffer and re-precipitated for approx. 6 hours at −20° C. after adding ¹⁄₁₀ volume 3 M NaOAC pH 5.2 and 2 volumes of ethanol. DNA was pelleted at top speed in a microcentrifuge for 15 min, washed with 70% ethanol and pelleted again, dried and resuspended in 10 μl TE buffer.

DNA was ligated into dephosphorylated BamHI-digested pBluescript SK II⁺ and dephosphorylated BamHI-digested lambda ZAP Express using standard protocols. Packaging of the DNA was done using Gigapack III Gold packaging extract (Stratagene, La Jolla, Calif.) following the manufacturer's protocols. Packaged libraries were stored at 4° C.

Mass excision from the primary packaged phage library was done using XL1-Blue MRF' cells and ExAssist Helper Phage (Stratagene). The excised phagemids were diluted with NZY broth (Gibco BRL, Gaithersburg, Md.) and plated out onto LB-kanamycin agar plates containing 5-bromo-4-chloro-3-indolyl-β-D-galactoside (X-gal) and isopropylthio-beta-galactoside (IPTG). After incubation, single colonies were picked for PCR size determination before the most suitable libraries were selected for sequencing.

Of the colonies picked for DNA minipreps and subsequent sequencing, the large majority contained an insert suitable for sequencing. Positive colonies were cultured in LB broth with kanamycin or ampicillin depending on the vector used, and DNA was purified by means of rapid alkaline lysis minipreps (solutions: Qiagen, Venlo, The Netherlands; clearing plates, Millipore, Bedford, Mass.). Agarose gels at 1% were used to screen sequencing templates for chromosomal contamination and concentration. Dye terminator sequencing reactions were prepared using a Biomek 2000 robot (Beckman Coulter, Inc., Fullerton, Calif.) and Hydra 96 (Robbins Scientific, Sunnyvale, Calif.) for liquid handling. DNA amplification was done in a 9700 PCR machine (Perkin Elmer/Applied Biosystems, Foster City, Calif.) according to the manufacturer's protocol.

The sequence of the genomic DNA fragments were determined using a Perkin Elmer/Applied Biosystems Division Prism 377 sequencer. The DNA clones were sequenced from the 5' and/or 3' end, and are identified as SEQ ID NOS: 1–121 disclosed herein.

This example not only shows how the sequences were obtained, but also that a bacterium (*E. coli*) can be stably transformed with any desired DNA fragment of the present invention for permanent marking for stable inheritance.

The determined DNA sequences were compared to and aligned with known sequences in the public databases. Specifically, the polynucleotides identified in SEQ ID NO: 1–121 were compared to polynucleotides in the EMBL database as of Aug. 12, 2002, using BLASTN algorithm Version 2.0.11 [Jan. 20, 2000], set to the following running parameters: Unix running command: blastall -p blastn -d embldb -e 10 -G 0 -E 0 -r 1 -v 30 -b 30 -i queryseq -o results. Multiple alignments of redundant sequences were used to build up reliable consensus sequences. The polypeptides identified in SEQ ID NO: 122–253 were compared to polypeptides in the SwissPROT-TrEMBL database as of Aug. 12, 2002, using BLASTP algorithm Version 2.0.11 [Jan. 20, 2000], set to the following running parameters: Unix running command: blastall -p blastp -d swissprottrembledb -e 10 -G 0 -E 0 -v 30 -b 30 -i queryseq -o results.

BLASTN Polynucleotide Analysis

The sequences of SEQ ID NOS: 1–18, 20–50, 52–62, 64–69, 71–83, 85–93 and 95–122 were determined to have less than 50% identity, determined as described above, to sequences in the EMBL database using the computer algorithm BLASTN, as described above. The sequence of SEQ ID NO: 94 was determined to have less than 75% identity, determined as described above, to sequences in the EMBL database using the computer algorithm BLASTN, as described above. Finally, the sequence of SEQ ID NO: 19 was determined to have less than 98% identity, determined as described above, to sequences in the EMBL database using the computer algorithm BLASTN, as described above.

BLASTP Amino Acid Analysis

The predicted amino acid sequences of SEQ ID NOS: 124, 133, 134, 137–139, 141, 148, 150–156, 159, 162, 164–168, 170–172, 174, 175, 178, 184, 187, 188, 190, 194, 195, 198–200, 202, 203, 205–208, 212–214, 216, 221–224, 227, 229, 234, 235, 237, 240, 242–245, 249 and 252 were determined to have less than 50% identity, determined as described above, to sequences in the SWISSPROT-TrEMBL database using the BLASTP computer algorithm as described above. The predicted amino acid sequences of SEQ ID NOS: 123, 125–129, 131, 144, 149, 158, 160, 161, 163, 169, 173, 176, 179–181, 183, 185, 186, 191–193, 197, 201, 209, 211, 215, 217, 218, 225, 226, 228, 230–233, 238, 239, 247, 248, 250, 251, 253, 254 and 256 were determined to have less than 75% identity, determined as described above, to sequences in the SWISSPROT-TrEMBL database using the computer algorithm BLASTP, as described above. The predicted amino acid sequences of SEQ ID NOS: 132, 135, 142, 145–147, 157, 182, 204, 219, 241, 246 and 255 were determined to have less than 90% identity, determined as described above, to sequences in the SWISSPROT-TrEMBL database using the computer algorithm BLASTP, as described above. The predicted amino acid sequences of SEQ ID NOS: 140 and 236 were determined to have less than 98% identity, determined as described above, to sequences in the SWISSPROT-TrEMBL database using the computer algorithm BLASTP, as described above.

BLASTX Polynucleotide Analysis

The cDNA sequences of SEQ ID NOS: 1–10, 12–18, 20–30, 32–42, 44–50, 52, 53, 55, 58, 59, 61, 62, 64, 66–69, 71–77, 79–83, 85–88, 90, 92, 95–105, 107–109, 111–114, 116–119, 121 and 122 were determined to have less than 50% identity, determined as described above, to sequences in the SWISSPROT-TrEMBL database using the computer algorithm BLASTX, as described above. The cDNA sequences of SEQ ID NOS: 11, 19, 43, 54, 57, 60, 65, 70, 78, 89, 91, 93, 106, 110, 115 and 120 were determined to have less than 75% identity, determined as described above, to sequences in the SWISSPROT-TrEMBL database using BLASTX, as described above. The cDNA sequences of SEQ ID NOS: 31, 51, 56 and 63 were determined to have less than 90% identity, determined as described above, to sequences in the SWISSPROT-TrEMBL database using BLASTN, as described above. The cDNA sequence of SEQ ID NO: 94 was determined to have less than 98% identity, determined as described above, to sequences in the SWISSPROT-TrEMBL database using BLASTX, as described above.

Based on similarity to known sequences, the isolated polynucleotides of the present invention identified as SEQ ID NOS: 1–121 were putatively identified as encoding polypeptides having similarity to the polypeptides shown above in Table 1. The amino acid sequences encoded by the DNA sequences of SEQ ID NO: 1–121 are provided in SEQ ID NO: 122–253, respectively.

Several of the sequences provided in SEQ ID NO: 1–121 were found to be full-length and to contain open reading frames (ORFs). These full-length sequences, the location of ORFs (by nucleotide position) contained within these sequences, and the corresponding amino acid sequences are provided in Table 2 below.

TABLE 2

| Polynucleotide SEQ ID NO: | ORF | Polypeptide SEQ ID NO: |
|---|---|---|
| 1 | 4828–5511 | 122 |
| 2 | 370–1485 | 123 |
| 3 | 617–2071 | 124 |
| 4 | 344–1162 | 125 |
| 4 | 1172–1936 | 126 |
| 6 | 513–1217 | 128 |
| 7 | 543–1352 | 130 |
| 8 | 599–1265 | 131 |
| 9 | 449–1189 | 132 |
| 10 | 1530–2306 | 133 |
| 11 | 164–1432 | 134 |
| 13 | 340–2367 | 136 |
| 14 | 92–2407 | 137 |
| 17 | 505–1884 | 140 |
| 19 | 5–271 | 142 |
| 20 | 6159–6464 | 143 |
| 20 | 5293–6171 | 144 |
| 20 | 3761–5293 | 145 |
| 22 | 282–1235 | 147 |

TABLE 2-continued

| Polynucleotide SEQ ID NO: | ORF | Polypeptide SEQ ID NO: |
|---|---|---|
| 23 | 1938–3620 | 148 |
| 24 | 1965–2924 | 149 |
| 25 | 2978–3901 | 150 |
| 26 | 1212–1991 | 151 |
| 27 | 10894–11889 | 152 |
| 28 | 3687–5126 | 153 |
| 29 | 250–1275 | 154 |
| 30 | 464–2593 | 155 |
| 34 | 92–397 | 159 |
| 36 | 460–1098 | 161 |
| 37 | 651–1481 | 162 |
| 40 | 92–2407 | 165 |
| 45 | 713–2266 | 170 |
| 47 | 237–1049 | 172 |
| 50 | 30–1469 | 175 |
| 52 | 40–1221 | 177 |
| 55 | 196–1347 | 180 |
| 59 | 505–1827 | 184 |
| 69 | 1192–2109 | 194 |
| 70 | 118–822 | 195 |
| 73 | 25–1419 | 198 |
| 77 | 63–638 | 202 |
| 97 | 424–1743 | 221 |
| 98 | 1008–1571 | 222 |
| 100 | 4987–6948 | 224 |
| 101 | 90–1090 | 225 |
| 102 | 1702–2514 | 226 |
| 106 | 5–915 | 230 |
| 107 | 925–2592 | 231 |
| 108 | 167–2155 | 232 |
| 109 | 131–1024 | 233 |
| 110 | 57–923 | 234 |
| 111 | 611–1962 | 235 |
| 112 | 53–748 | 236 |
| 113 | 348–1301 | 237 |
| 114 | 235–1659 | 238 |
| 115 | 634–1458 | 239 |
| 116 | 2339–3190 | 240 |
| 117 | 649–1527 | 241 |
| 118 | 94–924 | 242 |
| 119 | 1–1221 | 243 |
| 120 | 4011–5249 | 244 |
| 120 | 8691–9464 | 245 |
| 120 | 5246–5701 | 246 |
| 120 | 6229–7578 | 247 |
| 120 | 7594–8409 | 248 |
| 120 | 2357–3280 | 249 |
| 120 | 3461–4006 | 250 |
| 120 | 1347–2327 | 251 |
| 121 | 146–1168 | 252 |

SEQ ID NO: 106, 107, 109, 110, 111, 112, 113, 114, 115, 116, 117, 118 and 119 are full-length sequences of SEQ ID NO: 5, 12, 16, 44, 65, 71, 72, 78, 79, 81, 83, 103 and 21, respectively, with SEQ ID NO: 108 being a full-length sequence of SEQ ID NO: 15 and 42. SEQ ID NO: 253 is the full-length sequence of SEQ ID NO: 99.

SEQ ID NOS: 1–253 are set out in the attached Sequence Listing. The codes for nucleotide sequences used in the attached Sequence Listing, including the symbol "n," conform to WIPO Standard ST.25 (1998), Appendix 2, Table 1.

All references cited herein, including patent references and non-patent publications, are hereby incorporated by reference in their entireties.

While in the foregoing specification this invention has been described in relation to certain preferred embodiments, and many details have been set forth for purposes of illustration, it will be apparent to those skilled in the art that the invention is susceptible to additional embodiments and that certain of the details described herein may be varied considerably without departing from the basic principles of the invention.

SEQUENCE LISTING (253 sequences)

SEQ ID NO: 1 - DNA, 5739 bp, Lactobacilllus rhamnosus
caggccggttttttttaaaataaattttagttttaagttacacaatgattgattctagctcattcattagacttccgggcgcgccgcagatggcttactttcattaggaaaatgtcgtttgtaccactgcagcaaattacgctcattggtatttctcgccatccaaatcggcttcccgatccgcttcgcctcatccttagccgcaaacatttgactatggccaacaaaatcggtcgtcacaatcaccacatcagatttttgaacttttttcttcaacatcgcgccggaatccgagtgtgatgataacacgagtttgccaccgcgttcttcaacatggcgcttgactttacgcggcatggcggagttttcaaaacaaaccagcagcaaggttttatcggcaaagacttgctggacagctcgccgcctctttgcaggcttgaccgtcttgttcgctgtttgtgttgctttctgcttactagttgcagtgtttttatcagcgtctgtattcgccgactttgcatagcgttgtttcattcgggtcgcaaccgccgcggaatcagtgtaacgccaaatgatcttaccattgatttcctgaccgcgccgataagcgtagtcaatataatctcccggcttcaacttaaacaacatcacatcataatcgcctaaaagcaactgctgccgcgtctcgtgttccggtgattgaaactcaatataccaccgcttcacatcttcacgaaaaacagcaggcaaaaacttcaaccgtacaatttcggttggcaacggatcgcgcttcaacgttgtaatcttgtaattaacactatcgctatcctgatactcatcggcacgcacccagtccccattttccggtgggttcttcattttatgtaacttactttccgacactttaatggtgccgacatggccgccgttcaaatctaaatggaagcgaccaatgtacgacttatgattatttaaccagtgctctgataataatggtgtttccggttcaggattggattttggctgcgacggttttggctgttggggttgctgcggttgcgtctgctgctttggttcacttttagtttcaggcgctgtttgggtaatcatcggcgcaactgccgcattagattcaggttttgcaactgctgtattctcttgttgcggactcgtttcagaagtagtgtcaacaaaatcaatggctacaacgtcatttaaaagtttcagtaaatcttgaatgtcttgcgttattttctgaatattcttaggcgtcagttcagctgttttcgctgctacttgttgcttaagtaattcaataatctttaatttgtcattcattcaggcgcccgccttcatttaaggttgatttatctaattgtactgttttgagaagaatttaaaaagtgtttcgttctaaaataacgatcacttgtttcgttctaaaataacgagcactttagcagttcctttaaatctaaaaccggagctttacgctttctttacccgttgatcgccaataccagcggatatctcttcagtgtaatgaatatccttctttttagcatcatctaataacgcttgccacgccttccaaacattcgcttccgaatagcgatccgacaactcataggcttggtctgacatttgctgtaattcatccggatgggtgaatagttcaacaaacttagcggccatcgccttaatatcgccaaatggcacaacaaaaccatttttgccatcaacaactaattcattcgggccatagttgacatcataggtgaccccaaccatgccgttgctgagtgcttccatcaaagacagattaaagccttccatcacggatgcaagtgcataaacctgagcattccgttgaacggctccgacatcattggtgtaatcgtgcaacttgatcgcaccttgtaaatgatacttttcaattgctgcgttgatccgcttcatcgcccggttatcatcccggtggtcgacataaccatagacgtccaaagaaatgttagggacatctttcttagcaatcccaatcgctgcaacaatgtgatcaatttgtttttcaggggcaacccgcgccgtaaccagaacttttgccggctggcgatcggtcatggcaacatgcggtcgagccaactgttcatctggcaaaacgccaactggaatggtaaacaacttgcacgttgggtggaatcgctcgcgcacatcatgagtttgcttattggtagctgaaacaatcgcatcgtaatcattagcatgaatcaagctgtactcataaaaattattcatgaccgagtgcatcggatcttgggcatcgcctgcatgtgagttgtgtaaattcatgacaatataagcaggccgctgcaagtgaatgagttgccaatcgcccaaatgtgaccgatcaagaataaagacattgacttctttgtcattccagtattgctcattcacattattgtaaaaatgctgcgtcaaatcatctatattcgaaaacatataaaccgcaccgttgtcttcaatcaaccgccatccggtcttaatgaacgcatgattggcgtcatatttattaaaagtctcaataactggccgcccatcaactttatgccaaacctcagtccccaccttattatccggcgtataccactgcgacagcgacaaaaagccgcggaagtcataaaagtcaacccgatacaaatttccaaaaccatcgaattgttcaactgagctgacgcgttcagccgagtcatcctcaaagtaattgatccggccgacaaaaagtttgcctcgggtcaccaaatagcggtggttatctggctctttggcgtaactaagcttgtcgaatccaaaatcaatgtcttcagcgtgaagaattttagctggaacctgttcggcattctggtagtagtcaaacatgttcaaagcctcgtcatcactgaccccattatggtttaagtattcatgtaagcgaggattccattcgcgaaaaatcatcttgaaaggcacatgatgatcacgaaagagtcctgcccgcttcaattgagcgtgttcaatcccggaattatttttattaaaatttgaattaataaagaatatcatatgctaagctctcccctactttgagaatacgttaggaacagctgcttgttgagcctgccactgttgccaagctgccgcagcgttaaacttctgcgatgattcataggttgattcaagcatatcggcccacttatctttgtcggtcaacaacttaaccaacgccttggcaccttgttggctttcaccatttggcactaagtatccgctgatgccttctttaaccaccaacttcatgccatatttaacttgatagccgatcaccggcacgccaaaactcatcgcctgcaacacattcatgccgaacgcttctgaagaagaggtacttaatactgccgcggcgtctccaagcttttttgccaactggtcattgttttggtagccattaaagtgaacggcgtcttcaatttccagttttttaatcagttcttttagtgaattatcaagcgactgatcagatgagtaaccgtaaaactcaagatgtaagtctggtaagtcttttttcgcttttgcaaaaatcttaacggcttcttgtggttctttttccggtgaaattcggcccaaataaacaatcttattgcgatcacgtttttcagcagggaccagtttatgcggttcagcatatgaatccggcaccaccacgacatgcttaaagtggaagaacttatcgatttcttgcttttgctccacagttgggaccatgacgccatcaaagtcattcatgtgcgtggcaaatagtggttggagatagtcgacatagttacgcgatccacctgcttgttctggcttgtaagtatgggcactgtgaagaaactgccacttaccacgtgcgccaacaactgcggcaacttcactaatcaatgaaggccgatcattaattaagacgccagaatgtttaagcatcagttcattcatgaagaaaacaaacatttcattttcggtatcaaagcgccatgcccggccttgatagtcaagcagcttgtacatggtgttgcgcaattcgccattcacattcatccgcgtaatttcaatcttgggcttaccatcacgatcgtaaaaaacctgtgggccaaacgcaccatcaggatgaaaatactgggttgacgatttaaacccgcggcgatcccaaatgtctttagcgacaaccgtattcatatcattgtagtattcaatcgaccccacaagcccgactgtacctggcgcaatgttgactttaccgatcgttttaccatgataaacaattttagattcatttggatccacgccatcaatgtggtattgatacttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcatgtcattaaagctagtctgacgctcttgagccgttgtttcttcacccgtgatcaggtgatttgagacggtgaggattgataacgcctgtgcatggaacttcgcagccagaagatatagtgcaggggtctccatttcggtggctaacacgccgtaatcgatgagcttttgacgatccatttcatcgttgtagaagcgatcttctccgagcacattacccacatggtagcgcaatgccccagcatctgccaaatttgctgcctcacgcaaaagctgaaagtcggctattggggcaaaatacatccccgccccaaacgtattcaaaacgatgctgctgtctgtcgatgatccttgtaccagaatgacatcccgtaccttaacatcgctacccatcccaccggcagtccccactcgaatcagtgttttgacgccataatcctgaataagttcattaacataaattgaaattgaaggaatccccatccccgtcgcttgaactgagatccgtcgcccttcaaaggtgcccgtataaccaaaggcattacgcactgtattgtagcggacagccttttccaaaaaatgttcggcaatatattgtgcgcgtaatggatcgcccggtaacaaaacaacatctgcaatggcgccttttggagcgtcaatatgtgtactcatgatgaaaattcccccttagttggattcgggtcgacaaatgaacgacaagcaagtgacaaccgtcagatggctacccgtcatcatccggattgattgcaactacaactaccggatcctagcctcattagcgaagcagactcaaaaacgattgacctacccgattcccggtgaccccgaaattgtcgagaatggtggcccctaagtcggaaaatggcgatcggataccca

SEQ ID NO: 2 - DNA, 6365 bp, Lactobacilllus rhamnosus
ctcatcggatgccggaccagctggcggcatttggcaaacatgctgctgatcaaggttttggcgtgattattgcgggtgcaggtggtgctgcccatttaccgggaatgttagcggctaacacgctgctaccggtcattggtgttccaatcaaaacacgaacattaaatggcgttgacagcttgttgtcgattgtgcaaatgccaggaggtgtgccagttggaacgatggcaataggtgatgccggcgctgtgaacgctgctttgtacgcggcatcaatcctcgctttgcaaagtcctgaattaagtcagcggctggcggccttccgtcaagcccaaacgcaacgggctgaagaaagtgaggccacacttaatgattgatgtggttacctcacctgccacgattgggattattggtggcggtcagcttggacgtatgttaacccaaagtgccaagacaatgggctatcgagttggcattttggaaccgacgccgaattcaccagccggtcaggtagcagactttcaaatcacggcaccatacgacgatcaagcggcactgacaaagttggctaaagaatcggacgttttaacctatgagtttgaaaatgttgatttagcagctttggaagcagtacgtgatttaacccgaatccctcaaggaacagctattcttgccacaacccgcgatcgcatcaaggaaaaaacattcctgcaaacgcatggcgtaccggtcaccccctttgcggcagttgatcggcctgaggcgttgacagcagccattgagaaaatcggcttgcccagcatcttaaaaaccacgactggcggttatgacggtcatggccagcaagatatcaacaccatggctgatgtaccggcagccgagcagttgctagcccacggcccctgcattttggaaaaacgccaacagtttgaccgggaagcttcagtgatgatcacccgcgatggccgcgatcaagtacgggtattcccgattgttgaaaatcgccacaagaaccacgtcttgcatctcacactggcaccggcaccgaatatttcaccggttttggctgaaaaaattgatgatctggcgactaaaatcacacttggactcgatttacgcggagttcttggggtcgaactctttctcgaaggtgacaatgtcgttgccaatgaattggcaccacgcccacataactccggccactattcgattgaagcttgcaacttttcccagtttgacgctcacattttaagtatctgcggacttccgattccgcagattaccttaaaacagccagcggtgatgcgaaacctgcttggcgatgatctcacccaagccaaggcaaaatggccgcaacatccagaatggcacatgcacgattatggaaaagccgagatccgtcctggccgtaaaatgggccacatcacggtgaccgatgcgcgcgatgttatggacatacttaaacaaatggaggcagcatggtgaaaaagaccacattactatataccggcaaggccaagcaggtttttgcaacagatgatctaccggttcggcgatgataaggagatggccaagtcaattgcgttgtcagtgccaggcaagaccccgaaaatggctaaagcctacacgactgctttaacctggtcattggaatcaacaccagcgaataccacaagtaccccaagcactacaagcacgccaagtacaacgggtaccaccaaaccttaaaaagctggaacgacactgatgatttttggctagcatcaacggtttgctaacggacttgaaacattcaaactcattggagaaggatacgatgacggcactaggccgcatcgttgggggaacttaatcaaaaggagatactttgtgaagaaaaaacttttctgcttcataacgcttattgtgatgttgatcatgcctgccactcaagtttttgcttcggaattaaactttgctgctaaagccgagttaccggacaatcaagtgaatcctgatgttagctattttgacatcaaaatgaatcctggcgcgcagcaaacgttacatgttcagttgcgtaatgaaaccgaaaagccagtgacactcgatgtcgagcttgccagtgccaccacgaatctcaatggcgtggtggaatatacacccaacacgattaagccggcaaagagtttgcaattcaacatgaaggattatgttaaagcgcccaagcaaaccgttattccagctaagggcagtaccgttttggatttagctgttaagatgccggataaaagttttaatggcgtcatggctgggggaattacccttaaagaacatggcttgagtgatcaaggtggccaagcatcaggcaaaaaggttgcgatcaaaaatcgcttttcctatgtcatcgggctcctgatgcgccaaaacttagccgctgttccagctcacgttaaattgaatgcggttaagccaagtcaggttaatgcacgcaatgtcattttaacttcgatggaaaatgatacggcaaccttcattcagcaagtagccgtggatgcaaagatctttgctaaaggttctaaccaggcactttaccaagttgccaaagaagggctgcagattgcgccagatacgaactttgattttccaattgcgttggcggggaaagcattaaagccgggaacgtatgtggctaaactcgaagtctatggtaatcggcagccaaacggaaagatcttacgcacaacggcagaaggtaagcagcattaccgggatcactggaccatgaccaaacaatttaccattaccgaaaaagcggcttcaacgttaaatcagcgggatgtgacgatcaagccaagccatccgcagtggacgtacattctgattggtgctgtgatcgtcctcatggcactgatcatcctgctactgattttgctactgcggcgtcaggctaagaaacaagcttcttaatcaaaattgtctgagcaaggtgtttgcaagttttgaaaactggcggcatcatggacacaaataaaggactctgagaattcgtgaacgataccgatccagaagaaatgatgatatctgaaaattcgcgcctttggttatcagcaatgtttgctgctgatggcaaaagtgggcggatttttgccgtgagttcccaaagccgggtgagttatcgttggcggcgtttgaacttagccaatttagcgtatcggcttgccggaaaaacattgttggctcaatcgaggatagaacgtgctaaaaagtaaggtggatcttgtgaaattagttgaactgatggaaaaaaacgaccaaaagaagcttcagttactcaattatcttgatcaatatccgaatcgtcaggtaagaaacagcgagttacaggataaactacaaatttcctactatatgtttaagcgatggacaaaagaaattgtggacgatattgctacttttcaactggatgatcgttttagtcttgaagtgacggatgcatcaacgatcttgcatgagcaccataataccaatacttcggtctttttggcgcactatctgaaactgtcaccaaaagtcaatatcctgctgacgctgatgacccaacaagccacgtttaacttagcggactttgccgaggcgaactatgtgagttacacgtttatgtataaacgctatattgcgctgcgggagacattgaaaaagtggcagattactttgacgagccaaggcgagctgacgggcaatgaactcgcgatccggctgctattggccaaaatcatggtggtcacacatgtcactgaagataagtttaatcatgaggttcggctggccttagccgaattgctgggcctcatgaaaacaaccgatgccaagccgtcaatgagccaactgattgaaaccaaggcttatgtgctaattagtttgctccgctgtcaacagggctatacaattgcgagttcccaagaagtggctgatttggtggccaatattcgtcaaggtaccttggcaaccagaaacaaagcgattgcgatctatcaggctcattttgacgccagcgatcaggcaattaacagcgaatgtgactatttagggacatttttggcgattcttggcattattaattccgaggaaatcgtttttccggagacaattaagcagcgcgggcaagcttttatccacggatttgaagtcaagtttaaagtgacattatccgccgttgctaagctgaagattgcgtatgcagtcaataaatgttttgtagatgttttggtattaccgtttcgcagcgagtttttcgatgatcatatcgacattagctacttctttaaaacttacccgggattttttgagtattgtcagcattttgttttaaaccaggccttgcacttgacaagctcacaggcacagtttttgttttaccattgtttgttggcactcgccgccaatgttccgttgagcaaggtattagcaccattatcgatttgcgttgactttacatccggtcacgactacaacgctattattacgcgggatattcagtcattttcaactttgaacattcagatgacccagcaagttgaaccggaaacacaactgattattaccgacttggtgaatgcttatcatgattacgatattccaaaagtgatatggctttctccgccgcggcctgaggattgggaaaatttaattaatgaattactgcgattacgcgagcaggcacaagaagaattccaaaaacgctagaaatttttcgttgcttttttgcaacgaagaattagttgtgaaaatagtgtaaatggactagccacactggattaagcgcctttggataacaacggttattcaaaggcgcttctttttatttaactcaaaacattttgatattaataaatgtaatggtatactcgccctattcaaaaacggaggcgagacaccatggaaaaggaaacaggtttttggccggcgattaaagactttttctttcgtgccggtgattttaaaggcgttagttcacgctcacagtattggtgggtatttctaggacaattcttgttaggcattgtcattggcttggtatctgtgtcgttaggtgcgacattctcggcgaaaacgcaatcttttggcagcagcatgataagatcactcttgacaacattagtcgcggtccctatgtatctaagctacccgcaactgagtctaacgcttcggcggttccgagatgctaaggttaacccatggtggtaccttgtgctggtaatcgttgcattggtcggaccattgctgacggccaacggtatgggcttgttgccaatgatcatcttgccgcttattgttgcactggtaacactcattatccttctattacctagtcgtgaacagaccgtgaagccttttccagctcacccgcatacaggtagtaccactggtgtaggttttggagcggcagtcaaagatctattccttcgtggtggcgactttaccgggacatcgagtcgtagtcagtactggtggagtatcctattttcagcgttgatctttgtgccaacgttcttctttctcgtcttttcgatcactgcagcgctccttggcagcgctgcattaggcaaaatgcaaccgcagaatatcattaatatgattaattcattgggtattggtgccgtgattttggtggcgattatctttgctgttctctatggttggtcgatggtagctttgccaatgttaacggtcacttggcggcgtttcaaggatgcaggtgtcagtccatggtggttcatagctcttaacattgcgtcaagtatcgtctcggcagtacaaggaagtgtcccaaatgtcccattaaacctggtaacactcattcttcttattgcgcaaatcgtcatccttgctttaccacctaaagttcaaaatgacgaagcataaagtaatctgtaccacgcaaaaagtgcaaccttccgcagcggaggattgcactttttaatttgcgcttttagttgcagggtgaatcaataaatacctttttcgtcttcatcaaccagtggatcattaaagtttttgtggaagtacgtgctgtcgatgactttaaacttgccattcgcaaagcgggcaatgatttcgccgtattgaacgatgagtggttcggtattgggaatttcgattttcaggcggccaataggcgttttggtaaggtattgaaaattgtcgccgaagaagccttttaggtcttttgtattggtgtcgtgtgaatacggtaagaaatgggtcattttggccgttgaaaatgccgcaaattcgccttttgggaatccttccaaagatgaaggttgagccatggtattctcctcctaagctaagcgtgagccggtgggcgcgttcatgtgtgg

SEQ ID NO: 3 - DNA, 7754 bp, Lactobacilllus rhamnosus
attgcaggccgatatgggaataaacacacgatgcgtctgggtatgatcattggcttaatcggccagctggtcatggcaggtggcgtttatgcgcggaacttgtggattttatttcctggcattttgattaacagcgtcggccaagggatgattgtcggtttagtgtcgattatgttagccgataccattcgctatggcgtcaccctcggcgctcaggcggaaggcttatttgcctccagcaacgatttcggcgttaatctgggactcggcatcggcggcctcatcactgccggactcttcgacctcaccggatacgtgcccaacaccagtcaaaatgctgcaacgcttggcatgattaacctgaattatgtctggctgccgttggtgctgtatgggtttgttgctgcttttgattcacttttatccggaaaagcaaatgttagctgcgattgaaaaggcatcaggcttaagtcgcccagcaatgatatgggctgatgtttttgcccgctcacatgccaatacgtttttcccgcatcggctcgcgcgccatacgcgttcaccggtacaaaaaaagattcaacgacttccctaaaggcagttgttgaatctttttttctcactgagcatccagatcattttcatgaagccgagcaataacgggcaaaatcagccctaatgccaacaaaataaccggcgtaataatattcaagcccatctggaaccaccatgtgccggggtcattaagataactgattttcggtaacattcccaacaagcaggcaaaggcggtgaagaagaagcaccaacggcccacgagcatgcccaagcgtttatttttaaccagcatatagtcggcctggaacttttcgagatgttgatttagcaaataatacgcgaggaaaacccacagatagcgcaacggcatgaccacagagttcaaattaagcagccacttgtaaagctcgttcatgttgccaatgccaaacgctggaataatgatcagcagacttaccagaataccggtcatccagtaaccattaatcggtgtgcctttgcgattgatccgccgcaattttttaggaataaaatgcggatcggcgtcactcagcaagattttcagcggcgcatcaatggaaaatgccaacgcggagattgaggccaaagcattagcgattgaatacaaaatgacaaacaaaccgccgacgtgataatacttgcctaacattgcaaacgctgtgtatgggccattcgccataagatctgtcggaatgtggtggctgttaaacaacatccccataccaaaagaccctagcaacgcgcaaaaggcaaccatgcccgccagcaccagcatgcccagcggaaattccttggaagcgtgcttggtattgttgacgtatggcgatatcttttccgcgccgccaactgcaaagactagcatggagatcgtcgtgaagtagttgaggtcaaatttaggcaagtaagtatgaatgtcgcccatattcggagtcgccacatggacgccttttaccatcaacggtgcggtcacagctagaataatgaaaagaatcgacatcagaaacatcgccgtgcctgccatactgccaatacgattcaaggtggttagcccgcgcgaagacagccaaaggaaaagtaagaataacgccagacagattaaggaaacggtcatggacgagacggtgttgacaaaatcaccgttgcctttaaacagccagctcaaggcaatcaaaatcgcttgcggcttctgggctaaataagggatgtgcacgacccaataagtccacgccgcatagtacgccaatcgcacactgccggtttccttgatccaggaactaacgccaccggcttgatctttaaacgttgatcctagctgccccacaatcaaagcatagggcacaaaataaatcagcataatcagaatccagctagtgacaacggaaaggccttgttgtgcatagttattgaacacattgccaagaccccaaaccgatacgaacgcgattaaggccacgttataccagcgcagttgtttctttgtgtctgccacaaacatccctccaaacggtatcctgctcgattaggaacagttactcgctcttcagtgtaacggtttgaccacctctctttcccgtgaaattgtatagataaggattagatttttctaaaagcccggttgcggtttcgttatttcatgccgtatggatactcattaactggaagtatgaaggtataaaaagaccaccactgtaatgctgagtggcggccttttgtcatttctctttagctatcagccaagacggctaatattttacttaatagctttggcaactgcttcatacacagcttgttgctctgcttgaatcagatcgacgcgactggcgataacgctggtgtccatggtgatttcccgcgttaggccaggtgtcggtagttttggctcgaagaatttcttgaattcatcgagtcgttgcgtggtgcggaaaataccggcgataacggtgatgtaggtggtgaattccatgtcgccgccaaccgttttttcaagccaagcccattcgttgcgaacccaatcccatgctgcttgttcgccggcgtggttgctcaagacgccgcggaaccatgagcgcaaatcttgcggcttaatggtgtcggcattttcaaattgatccacaattttagcgattaacgcggcatccggggtgctggttaacgctgcaagaatatcggctttgtagcttgagtcggttgtctgcttatacgccgttaacaactgatcgaacaaggtggcactgccgaagtttttcacttcattttgaaggacaaacatccgcacatcggccggtaattgaagcaggtgatccttatttgccgtaaatagatcgtgaccttgcgcaatggcgtctttattcttagcatacaacgccatgcttaggatataaggacgggttaattgatcatcattggattcgccgacttttggtgtccagcccaggcgcttgaactggtcggcgctgagttggttgaagaaggttttcagctgcgtttcttcggctgaatccgggttgacgaattgttttaagtcattggccacccgatacaaggcgttgatgacgatggcactgtgactctgggcaaaccgcggcagcaacgacacaatgtcggcataagcattttgccgaccctcagccaataaccgtagatcttgaagtacctgccgctgatcaatcgcattgagttggtcaagatgcgccaaaatatcggcgagtaaggtggcgtcgtatttcacgatgaaatgcgagttattgcccacatttacacggaatggttgaccgcttgcttcgcgcaactgggtgtaatcgcccaaggttacctgcttatccgcaaaaatctgcggtgcggcagcataattgctattgagcggaatctgccattgcctgcctgcatctttgcctgcaccaatgaagaattgttgctgggacaaggtcagtttgccatcaaccaccgctgctgtcaccactgggtagcctggttgttccagccatgactgcatgatggtgccgacatctaacttagccgctttacccaaagctgcccacaaatcagcaccggcagcattgccaaaatgatgggcctcaaagtatgccttcaaaccggcccgcaacgcatcatcaccgattaaggaacgtaccatgaccagcatccgcgcaccttttgcatacacaatcgcgctgtcaaaaagcgaatcgatttcagccggatcttctacttgaacatgaactgactgaaccccatccgttgcatcacgttgcaacgccattggtacttccagtgtctggaatgtttcccaaatatgccagtccggttgcaaggcatcaaccgcaacatattccatcatgttggcgaaactttcattcaaccacagatcgtcccaccacttcatcgtcaccaaatcaccaaaccattgatgcgccagttcatgcgcaataacggtagcaacccgctgcttggtttccagcgaggtattgtccggatccagcgtcagcaacgcttcccgataagtgacaagcccccagttttccatcgcgccagccgaaaagtccggcaacgccaactgccaggaatgcggaagtggataaggggtctggtaaaagtcttcgtaaaattcaatcgagcgcttggcaatgtctaacgcgaagtcaagctcattaggttgatgtgctttggtagcaaaaaccccgattttaacgccgctcttggtggttgtctgcttattttgcaattcaccaaatgcaaaggcgatcaggtaagtcgacatccgaaccgtggtgtcaaaataatgaacgccattttcttcacgaacttccggcatgttactgataatcgtttcaccgggatgttcatcaaatttaattgctaaatcaaacgtcgccttggcttcaggctcgtctacactaggaaacgcctgacgtgcagccgttgtttcaaactgggtcccgataatctgcttcttaaccccgtccacttcgtaataagaaggataaatacccatcatggtgtccgtcaacggtgcagtatacgtcagtgtcaacgtcaccttgccagcttgcggcaaagtaatccgcaccgcttcggcaggatcatccaccgtaaacggaacatccttgccgtcagcctgaaccgcactgaccgtcaaatacttctgatgaaccgcaatttcggtttgcttggcatcaccggtaatcgtcgtcttcccggaaatcttcttcgtctcccggttaatatccaagtaaagatcgtaatgtttcggttgaaacaactgataaaaatgcgtggctacaagcatgcaccaattcctcttgtgtgtgagcgcaacccaccgcggaagaagtcggagtgtaagccgccttgggcgtgatagccgccctttggccattgggacccaggtccttacacccaaacttttgcgctggtgagcgcgttatgaacaaacgccgacccaacgccggtgaaaaacccgaccccgtgatgaataaaccccccacccaaacgggttaaacccttacaccggcaaacccgtgatgaaaaccttaaataccgcttattttaccccaagtgggccccccgtttgtacaaaaaatcacaccgtctaaaccgcttggttgcaagaactattttaaacgggttaccaatcgccgccgcgccaaaagaaagtttatgatcatcaaaacccccgcgacccctagtggaacccaattatcgtttacgggtcgctacgccattaaggtcaacaagtttaccagcccataattgattgctaccaatacaaagcgcaaagtagacggtcggaattaaatacgccaccgcaagtgactgagagcaacagtaactaccaagcgtgatgctcccaataaataaactcttaaccagcgcattgcccaacagaacgccagcagccaatgtcgttccctgaatctgatatagaccaagcagcgtaacgttcagcactgccaacacgccaaaataccaagcaaatcgcaccgcgtaaaccgtccacaattggatcgatttactattgataactgccgctacccctgttgtttgctccggtaaaaataagctgccaaaacaaaagatcgctagcaacggcatccacaactcagtcggcatcgctgcttgtgccaagctctgcggtgtcagcgtaaaaacaatcggaatgagcccccagccaagtaccgcaatgaggctggttctcaagacgttggttttaatttctaatcggacgaagcgacctaaacttgagtgcatgtagttagctccccgttgtgcagccaagatccaagcagttaacgccatcagtccaagcgccaacaaagcgtatccgagccgattttgcaacagctggtttaaatgggcatagtaatacgcgccattgtgcagcgaattatgccgcgggatcaataaccatccgtagttaccactcactcggcgagcacccgccatcatcgttaccaaccaccagccaatttgaatgccaaaaccaataaaattaccaaagatcgccgcacttaaatagccaaccgcactgctgaccatgagcgttggtaacacccagataaaagccattttcacaatcgcggtataatccaacgacatcccttggtataaaacggcgacctgaatcgtcaacgcaatggcgatcacaatcactggcacaaataaacttcctaaactcgcgacataccgcgtcaataataagcgcggcgtggtcatcgccttggtttgaatcaccgccgacgcatgatgccggcgatcggcagtacaaaaagcaatggccacaattgtcggtaaaatgcccatcatgattccggcaatatccgcaaacaatctcgcaaacgctccggtgacccgatcacgttgccgaatgagctgctgatccgcgacgacttcggctttcgtcatccggcgataagcaaaattctgaatattttgtgaactgtacgcagactgtccacccaagagccggtcaacttttgccaacgttttaaccaagggtgcgcgcgtgtctgcatcctccgcctcagtcatcaactgccgaacttttgcctggtctgccgcgcgtaacgtcacttgttttgcaaaccccaacggataagtcgtatacaaattatgccgataatcgtagtgcaactgatccagactgtttgtcttgagtgtctgataatcggtcgctgtaatattttcgtagctcgctggtgatttcggcagggtggttaagtttcgtgaaagtaatggccagacattcatcacgataaatgccacgactaaaaatgtgtaaataacaaacgttaaacttcgcgtctgccgcttaaattccatccaaagtagcttcacaatgacacctcctcacacactgcttaccgtcttcaccaacgcttgatgatgctgagtttgtgaatacagatacgcctcctccaacgttggcgcaaccgattgccaagttgccaacggagtacgagctaacaagcgtacccgaatatgctgcccgtgcgctgtttgttcactaatctggtactgcgtcttaaactgtttaagctgcgccaccggtaagtcaccgacaaaaacatgccccgcagccgcatcaataagctcgtcagtggtcccattgaaaaccagtcgcccatgatcaaggatgccaatacgattagtcgttgcctcaacatcggaaacaatatgggtagacaagagtaccaaacgctcattagcaaaatctgccaacaaattccgaaatcgtatccgttcttccgggtccagtcccgcggtgggttcatcaacaatcaaaacccgtggctcattcacgagcgcctgcgcaatgcctaaccgttgcaacatgccgccagacaacgccttgactttcgttttcgcctgagctgtcaaatgaacagctgccagtaaccactcaattcgccgcttctgctcgcgagccggcacctcagctaagattgccaaataggtcattgcgtcaataactttcatggttggataaaacccgaactgttgcggcagatacccaattttgcgccgaatactgcgcgcatctttaagtggtgtgccatccaccaacaccttaccggaagtaggtttctcaagtgttgtcaaaatcttcatcaacgtggatttaccggcaccgtttttccccaataatccatacattcctgactggatattcaacgaaacgt

SEQ ID NO: 4 - DNA, 2483 bp, Lactobacilllus rhamnosus
agggtgtggattccacccaactgggaatcgcggcgtaatatgtgcgaagtcccccttaaacccattttcggaccgggccgcaaaccgttggccggtggctatttttgggaaaaattcaacttctgaaaggcattccacgcctaattccgtttgttgttttcttccggaaggttagtacccgtacttgttattcgcccgtgttgtttttcaacggtgggcgccccgctaatataggcaatcgcactatttaaaaagatgccggcggcttaaacggggttaggctttttagtatcaattaggctttacccggtatgataatcccgataatacgtggagtcagaggatgcaagaactggaaaagtattcattagatgacacttatattcgaccatttgatcgcgaaaagcaggaaattgcgcttgaaacgaaagatctgcatgtcttttatggtgataatgaagccattcatggcgtttcgctgccgtttgaacgctataaaatcactgcattgatcggttcaagcggctccgggaagtcgacatacttgcgctcactcaatcgaatgaacgataatattgaaagtgcgcgagtcaccggtaaaatcatgtaccggaatattgacatcaatagtgatgcggtcgatgtttatgagatgcgcaaacacattggaatggtatttcaacggcctaatccatttgccaagtcgatttacgacaatattgcttttgcactgcgtcggtttggtatcaaggaaaaaaagaaactggacgaaattgttgaaaccagtttgaaacaggctgccttgtgggatcaagttaaagacgatcttaatcaaagcggtatgtcgctttccggtggccaggcacaacggttgtgcattgcgcgggcgattgccatgaaaccggatattttactcttggatgagccggccagtgccttggatccgatttcgacatcggcagttgaagataccttgttgtcattaaaagataagtatacgattatcatcgtgacgcataacatgcaacaggcagcccgaattagtgactacacggcgttcttttatagcggagcagcgcttgagtatgatgaaacccgtaaaatcttcacgcgtcccaagattaaagcaaccaacgattatgtttccggacatttcggctaggaggttcccatggctgaagcacaaaaaatcattacaagttcagatgttcatcttttttatggtaagtttgaagcgctaaaagggattaatctggattttaacgaacatgagatcacagctttaatcggaccttctggctgtggtaagtctacgtatttacgaacgttgaatcggatgaatgatctgattccgggggtgacgattacaggaaccatcagtttacgcggtcagaatatctatgcgcctagtgaagacgtggttcaattacgtaagcaagtgggcatggtcttccaacaacccaatccgtttcctttctccatttacgaaaatgtgatttatggattgcgtttggcaggggttaaagataaaagcattttggatgaagcggtggaaaccagtctcaagcaggcagccatctgggatgaagtgaaggatcatctgcatgacagtgcattatcgctttcaggtggccaacagcagcgggtttgcatcgcgcgggtattggcagtcaaacctgatgttgttttgctagacgagccgacgagtgccttggatccgatttccagcacgcaaatcgaaaacatgttactcgagttgcgtgaccaatacacgatcattctagtgacgcatagtatgcatcaagcatctcgaatttccgataaaaccgcctttttcctgacaggcaacctgatcgaattcgctgacacgaaacaaatgtttttaaatccaaaagaaaaggaaaccgaagactatatcactggacgcttcggctaggaggggtagtatgcgacgactttttgttgacgaattgaacgatcttcatgtacgtttttcggaaatgggaatgatggttaatgaggccatctataagtccgtgaaagccttcatcaatcatgacaaggctttagcccgcgaagtgatccacgaagacaaacacattaacgagcgtgaagttgatttggaaaaacgcagcttcgaattgattgccttgcagcagccggtgacgaccgatcttcgggtgattgtcacggtgatgaaggcaagttccgatctggagcggatgggggatcatgccgtttcaattgctaagtctactattcgagttaaaggtgaaacccgggtaccgcaaatcgaagctgatattgccgggatggcagacgcggtaaaagagatggttgaacaggtgctggatgcctatgtgaaggaagattcagcccgtgcacgtaaaattgccttggaagatcacggtatcaatgacttttcatcgcggatttacaaagagtgtatccgccagatgcaggaaaaccccgaaaccgttgtc

SEQ ID NO: 5 - DNA, 1720 bp, Lactobacilllus rhamnosus
attcgagaagcgatgctaaaaaaatcgcgctcatcaaagttagagcggcgcggcaaaacgattagcctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatggaaatccggaagttggcgctttaccgatgattgtcgggtctttcggcgtgacttttttatcggcaatcgttgcaacgccatttgcagttggcgccggcattttcatgaccgagatttcccacaagtgggggcaaaaagtgctacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgactgtaacatccatgaccgtcgatgcgttaaaagctgtcccgcgccattatcgcgaggcttcattggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggccttgttgccaaagaaccttgtttcgccagcttcgacgttgacttctgttttgacgagcgggattggtaatacagtcatgggctcgctggaaaataacgctttatggtccttggcattgctactgttgctgatgtcattagcctttaacctgttgattcgttggatcgggaagaaaggggagctgaacaaatgaatccaaaagttgtcgataaaattgccacaacggttctgtacattgtttcagggattatcattgttattttggccagtctcctcgggtacattctttttaaaggggtaccgcatatttcctggcattttctcacgagtccagcacaaagctttgaagctggaggcggcattggcattcaattgttcaactcgttttatcttttagtccttgcgatgctgatttcaacaccgatttcgttaggggcaggcatttacctcagcgagtatgccaaaaagaattggttgacggatgttattcggacttcgattgaaattttaagttccttaccgtctgtggttgttggactgttcggttttctgattttcgttttacaattcaaattcgggttctcgattttatccggggccttagcattgaccgtcttcaacctcccgttgctgacgcgaaatgttgaagattcattacgcggcgttggctttgaacagcgtgaggccggcttagcgcttggcctatcgcgctgggagacggttttacatgttgtcatccctgaggcattgccggggattattaccgggatgattctaggtgccggacgggtttttggcgaggcggcggcgctaatttacactgctggtcaaagtgccccggcgctggatttcaccaactggaatccggctaatattgcgagtcccctaaacccatttcgaccggccgaaacgttggcggtgcatatttggaaaatcaactctgaaggcattcaacctgatgccgttgctgtttctgccggagctagtgccgtacttgt

SEQ ID NO: 6 - DNA, 1717 bp, Lactobacilllus rhamnosus
ttttcaaaaatggtcgtgccactgtatcgctcggctacatcggtctatatgaagtcggaacggtcttttatggttcagcatgggagaagaatcatgacgccaaggccttttccgtttcgattgtgaaggcgctggacgatccttaccatgcctgcgatgacaattgccttagtacctgtgttggtgagtttgatactcggtgccggcttaatttggcaagcacatcaagtacatttaaacgtgacacaaaccaatcacggggtagttgtcatcggggttgtcccacagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacctgtaagattcgtgaagaaaagattcaaacgccaatcatgattctgacggccaaagacaacgaaaccgataagatcgtcggacttgaacttggtgcggatgattatgtgaccaaaccgttttcgccgcgggaaattattgcccgaattaaagccatcgaacggcgtagtcaaagtcaaccacaagcgccactttcccgtaatgccaatcaaattacggtcggtcaaattacgattgatcctgaaaattataaagctagcaaagccggacaccgactccaattgacccctaaggaatttgaactattggtttattttgctcaacgagttggcaaaacgctatcacgcgatgctttgctcaatggggtttggggcttcgattacccggcggaaacacggatggtcgatattcaggtcagtcatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctgggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccgttagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaac

SEQ ID NO: 7 - DNA, 1494 bp, Lactobacilllus rhamnosus
tcaatcaagcctaagtagccaatgatcgaggtcaacggtgtgcggatatcatgactgacattggtaatcagctcatctttactctgttcgattcgtcgctcctcttccatagagttcacggtagaatcaaccagcgcattaatgctgctaaccactttttgcagctcggtattcacctcaaatttaattcggtgatccaagtggccatccgcaatataatgcaactctgcaatcacgtggcgcatctgcatctgccgatatcgccgtgccaatcgccagtacaccacaatgacgtctgcaatgcccatcaaggtaaggaaaagattcgaccagctccacagatgaaaaccgccgcggccaaaagtcaaattcgtcttcacaccccagattgcattctccaacccgggattatgcgcaatcatctgattaatcagcactaacagcgcaaagttcagcatcagtaacaaaataactgtcacaatgccttcaatccacaactcggacttttccttaccagtgagtttgaccttttcgctcatgaactaggcctcgaccttgtagccaacgccccagactgtttcgatgaccttctcaccatctgttgcctcttcaatcttgtcacgcaggtgtgaaacatgcaccatcacggtcttggcggatacaattgactcctgttgccaaacccgctcaaaaatctcatcagcggaaaagacgcgattcgggtgactggcaagcaagtagagaatcccaaactccaaagccgttaactgaatctgtttgccggtcaaagttgtgacctcgtggctatcctttttaatcgtcaaaggcccgacttccagcacatccggctccgaattggtcacctcattttgactccgacgcaaaagactcttgactcgcgccatcacctcaagtggattaaatggcttcgtaacgtaatcgtcggcgcccgtgatcagcccttgaatcttatccatatctgctgttttagctgacacaatgataatcggaatttgcgaatccttacgcacttccttaaccacatccatgcctgacatattcggcatcataatatccaaaatcattaacgcaatatcgggattggtcacgagcttggtaatcgcttctttgcccgagtatgcttgaattggttcatagccttcgtttttaacataaatgctcaatagttcaacgatttctttatcatcgtctacaattaatatcttcataattttgactccatttacacggcaatcgttagggactgtaacatcactgtccattgtaccaaaattgaaccgggaattctttacgaaaaccctaagaaaacgagtgccatacgtgctttgcatttcaagtgggaggtgttcttttgccaaaattaacaaccctcgtagctgccagtttgccgcaaacgatgcaaattgccggtattaacattgcccattcaagcggtagtacctattggctgcttcaccaccaagacgaatggct

SEQ ID NO: 8 - DNA, 3356 bp, Lactobacilllus rhamnosus
atggccggcaatcctaaccttccccgtacttggcgtttcaatagttgccaaaatgttcaaaagggttgatttgcccgcaccactaggacccatgatgccaataaactcacctgccttaacctgaaagctaagatcgtttaaggcccgaacccgatcgtgacgctggccgaaaatcttacttaaattagatacttccaaaattgccatgggcttacctccgtcatcatcataccaaaaaccgccacattcaacatgcctgtgcgactatcaagctttctaaacaggacaggttaaaggcatcagaaaaagttccgagaacgtttcaccataatatgctcaccggcgcagggatctgcgtgtaaggaccttgggcgcaatggccaagaccacttatgttctaacttacgcccataacgcgctccccggcgcagaagtctgcgtgtaaggaccttaagcgcaatggccaaagcccggccatcacgcttaaggccacttacactccgacttctaagcgcgccggctcgcgctcacttttgtttgtgtctcggccacaaaacttgtacgataagttcaggaatggagttggtcgcgtgtttaaaatcatgattgtagaagatgatcagacaattagcggtcttatcgctgacaacctcaagaagtggcagtttgagcctgtcgttgtgactgattttaacgctgtcttcgatgattttctgcaggaaaaaccacatttagtcttattagatatcaatttgccggtttttgacggctattattgggtccaaaagattcgtgaagtctcaaaggtgccggttattttcatctcaagtcgcaacaccaatatggatatggtgatggcaatgaacatgggtgcagacgactttttgaataaacctttcgcgatggaagtcctcatcgcaaagatcaatgcgctgttgcggcgaacttataattatgccgatcaaggaaccgatgtccttgaacacaatggactcatgctgaatctaaaaaacggcatggcccaaattggcgaaaaggaaatcaatctgtcgaagaacgaatataaattacttcaaattctgatgcggcaacatggccaaattgtcagccggtcaagacttttgcgcgacctctggcaagatgaacgctttgtggacgataacacgctcacggtcaacgttaaccgcttgcgtaagaaaatcgaagaagcaggattgaaagactacattcagactaaagtcgggcaaggctatatcgttccctaggaggcagccatgcgttttcgcgattattttaaagatcatatttgggcgattggcggctatattttatgcgtcggtttagctgccatcatcgtttggctggatccgcaacaccgcgttaaattggcaacggtctggtatgcggtcttactcgtcacattggttgcaagtgccttctttatcgcgcattttgtccgtattcgccagtttgctgctcgcttgcaggcgcgccggaatgctgaagatgctgctttggattggccgctgccgggtggccaatccggactggaacaggttgtctcggatacttacaacaaaattctgaccttgcatcggcaacaaatcaccgcgcttttggcccaacatcaagaccaaaaagatttcattgactcgtgggtgcatgaaattaaagtaccgttggccgcggtttcattgcttgccgaaagttttgaaggccaggttcccgatgacaagctggataacctcaatttacaactggatcaaatcgaattttatgttgagcaggtcttatactattcccgacttgacagcttttcgaaagattacttgctgcataatacgcaattgaaaccgctgattaatgacgttgttgccaatcaacgtaatggcttcattaacaaacgtctgtcatttaaactgaacggcgatgaccaaaccgtcttaacggacaataaatggctgcggtttattttggcacagctcatttccaatgcagtcaagtataccccagaaggtgggcgcatccaggcaaccattcgcgacaccggcaaggaaacccagctgatgatcatcgacaacggcatcggcattcctaaagacgagcaacaccgcgtttttgaaaaaggctttaccggtagcaatggacgcctgtcaaatcataaatcgactggtttgggactattcttagcagaaaagttggccgaaaagttagggcatcacttaacgttgacgtccgtgatcaatcaaggcacaacggtcaccattcattttccatatgtcagctattacaatgatgctggtcaaaccgttgaacatcccaaaaaggcacttcatcaaacagcagatacatctgattcatccaaccaaaatgagtaggacattcttctttaacgaataaagcgagtagctaagcacacgaccgtcattgttgtcttgtggctagctactcgcttttttatctgtctatattttgtttgcagcaaagaacccaaccaccagcggctgcgactttaatcagggtcaaacttttatcgaatgaggtttttccaaagcttgatctcacccgccgcctgggttgccggcacatcaataatccgttgattggaactgccgcgaaattgcagcgttaagtctttttttgccaacaggaagcgcccatccaccaatatatcgatgaggctcagcagcgttaacttgtcttcagaatcctgcatgagttcttcgtaagtgtaaccgctccaactccagatatccttatcatgcccaaactcttgacgaatccggcggcaaagacgaatgcacacctgagtattcaagaaaggttcaccgcctagcaaggtcaagccttgaacatatgactgacccagatccgcaataatccgatcttccagttcctgagtgtatggctgaccataccgaaaattctgggcgacacgattgtaacaacccgggcaggcaaagcgacagcccgagacatataaactacaccgaaccccttctccatcaacaaaattaaacggcttgtaatcagcaattcgttgttgtgaaagttcactagcaagccattctttcggttgtggattctgcggtaaacgagctgtggtcatcataagatccgcatcgttttttatggtcattttcttaaataatgggcatcgccttttcgctactaaacaacaaaagcggtaaataccgatttatcgatggttaaacatcttatctgcaaagtaatcccaataagtctttgtgccggtgataacagatgcttggccggctaatccataataaagggactgccgctgcgatttagataatttcacccgcgccttgaccgtaaagaagttaccaactttc

SEQ ID NO: 9 - DNA, 2802 bp, Lactobacilllus rhamnosus
ttggtcgccttagtggatcctcaaccaactgccatgcttcttcaagtgcttggcgaagggcttggcggcatcgcttcaaatgcgcctaccaattgccccagttcatcggttgtcttggcatgcagttcaaaatccagatcctgagcctgaatatgtgccacccccgcctttaactgggctaacggcggtgcaaacttaagccgataaaccatccgcgccattgcattcataaccgcatataaaacggcgaagctaccaataatcgctccgccaaaatacaaaccgacaccgcctaaaaaccagtgagtcgctaaagccgtcgttaagtgaaacatcaggagatgccagacttgtaaaaatagcaacatcatgatgccggcgacaatcgttcctagcagaatcatctgtaaaagtgcttttttaatcgatagcttcataaagtgtgcttttaattttgccatttatatcccactccccaaaccgttacgatgggcgatgttacctgacaggcatcaaagagcttgcgaatgcggcgaatgtgctcggtgatcacccgctcatccccttgtgcatcgtagccccaaatcttttcatacaattgctcgcggctaaacacctgccccggattcaggctcagccattcaatcagctgatattgcttattttcaagttttaggcaagtcgtatccaccgagacctgatgcgcatgataatcaatcatgatccgtccaaaaacggcaatctgcgcctgtttgtccggctgatgggcccgtctgacatgtgccttgatgcgtgcacctaattccgtcagactaaacggcttggtcacatagtcatcaccgcctgcgcctaatccctgcaccttatcctgatcggtaatacgtgcggttaaaaagataatagggacagaagtgatcgcacgaattcgactggttaaggtaaagccatcaatatccggtaaattaacatccagcaaaatcaagtcaggctgctgtgccaattgactcaaggctgcttgccctgcatctgctgtcagtaatcggaactccggtagccgccacgcaaaataacgctttaacattgccaaaatagcagcatcatcatccaccgccagtaccttcgtctgcatgccttcaccctccattgccccaagcctattagctccgcacttatatcgattatgattcattgcaaaataagtgtttcctaattcaactctacctgttgccgcaaccgcttgcaacaaggcatctgctgggtgatattaaaaaagcactgccagctgctggcagtgctcatgaactaacattaaattccactctaaacacggccagattaataccgaatccggaaagttttaggcgccactcggtaaatcaccgcggtaccgatcccgacataaagcaacgtcaccgtaccaatgagaatcgcatagccatagccgtaaaaatgaatctgcgtaaaaagccacgccacccaatacattccccaggacaagaagcggtacagcggcgatacaacatccatatcatccgtaaatggctgcatcagataataaataaagagatcatgaaacgaaaagaacaacaccaaaccacagatctccagcaacaacaccagataaaagttgacctgatcggctaccggtgcgattaactgcagtgcaaaaatcagcaggaaaaccgtgaacccagtcactgcattgtattgaacaatgtgccaaaaccgataaaagaatccggctaaaatggtcttaggctggcggtaaaaaggataatacaacattgccgcgtcacaattaacaaataacagttgaacgatttggccacccagcgaggtcaaatacatcaaaaagaaaataccaccataaatcggcgtcagatcgcctaaattatggacagcgaaaagtttcaatgcgatcaaaagcccaccgccaagtccaataacccacagcagacgggtccgcaactttttccatagctggcgacgataacgggcaaacaacaaggcattgagataattactgccggaacggttttcagacttgagggccacggtggtatccagcgtcagtttcttttgcattgcagttcctgccgctagaagttgctgctttttggctgaagcaacaagatttaacgcccgcactgcagactgaatggaggccatgattaacgaattatcattcgaaaaacggtaaatgtaccacccaatcagcaccacactagcccatgcaatcagaaagcccagcggcgaaaaaacgccaaacgtaaaggcggctaattttccggttactactaagccaatgggtagccccagcaaactcagccaatacccaatctgcaccagcaatcccagccgccagtgtgcccacagcagccgtggaatgaaactcggccataaccacccaataatggcaatcggcagtccaaccaaaaacagccacatatgctgcgtcaacaaggcgagcgcaaacataggcagtagtggcccaagtacaacgccgctgatttgatccatcagcatcaacccgcgcaccagtgccggccgatccaaggcaaaataatcccctagtttaaccgacttgagactcagcggcagattgcggaataccaagccgcgaaacatgagaaaacccgccagataaaccagtaccgcgatcatgacgcgaagtgaaagatcggttgccagtggatgcacataatcgtgatacgcactaccaaccaaaaatgctagcccgatcagcaaaagcgttgtcaccggtattagcaaaatcgtgaaaaagttaactgcaattgccat

SEQ ID NO: 10 - DNA, 3045 bp, Lactobacilllus rhamnosus
ttgaagctaccgtgtttggcgaggttcaacagatcttcggtttcatattcgtacgtatcgatcccgacgccagccagtttaccggacttcagattgctgagcatcgcctgggtatcaatcagattcggccgcgcggtgttaaccacaatcacgcctggcttcataagatcaaacgctgcctcgttgataatgtgggtattttgtttaatgcccggaacgtgaagatcaatgatgtcactttgtttgaatagttcttccaggctgacatattcaaagtccggatgatcgcctttcatcggatatggatcgtaagcaatcactttggcaccaaaacctttgaagagcttgatagcaacgcgaccaatgtgcccggtacccatcacgccgactgtttgctgaccaagttctttaccgatgaaggtgccggctttttcgtagtcgcctgcctgtagctgtgcttgaacctttcccatgttgcgaagtagatataacgtatcggttaacgcaaattcagcaatggcagccggtgaatatgcgggaacattacttaagcgaatgccatatttattcatcgccgccatatcgatattgtcggttccgacattgcggatggtgagaaacttgatgccatattcgtgcattttttcaaacacaccagctgcgtatggcgtcgtttgtagtgagttaatgccgtcaaagccttttgcccattcaacagtatgctcatcaagaaattccgtatgatattccagcgtgttgccggtttccttagcccactgcttgaaatattggatctcatccacgcgtgcaccatatgcaataatcttcatattctcaatatctccttgatttcgatttgtccattcatcagtatacaagattatgctcgtaaaatagaacgtttaaccgctaccttttgaaaaacttactactgattaaaaggttggatgctgcccttgttccaaagctaacaatttgcgtttcaacgttaagccaccgcgaaacccgcctagtccgccatctgtgcgtaatacgcggtgacagggaatcgccatcattaatggattccgcccgacagcattgccgattggcctgaaaagcacgtggccgatcaactgctgcggcaacttgtttgtaagttcgggtttcaccatatggaattgtcatcaaataacgccataccgccacttgcagttttgtgccatgaaagactaacggcaccgcgatctcccgactgtcaccgcttaaataatcataaattgcattgcgaaaaggcaacatctcctcgcgatcaaataccagtggccctttgatataacgcgttgcttcgcttagtttggcatccggcgatccgacaaaagcaagcttaccttgatcaaccacaatcaagtaattgtgctcaggcatgtttagccatgtatattgcatagaaaaatcctttccattaaaaaatcgcccactcagaaaaaatattatcgcgaatctcgttgctatcagtgatgccagcctatccacctaatcgctaagccatgacaaatatgtctgggatcagtatactgttcagcaaacaacgacccatcgacccgcagcgtaaaacccgacttacacgtaccaaaaaggagagacttactttggtcaaaatcctagtggttgaagatgaccgcaactttaacgacctgattgcaaccatcttacggcagaatggttacactgttcaaggtgccgaaaatccaccggcagcctatgatttactgcaatccgaacaattcgatctcgtcttatcagacatcatgatgcctcaggtagacggttatcaatttgcacaagaactgcgccgaaccgatccaagcatccccatcctcttcataacggcgcgagatgatattgcgtccaaagaaaagggttttaatagcggcattgatgattatatggttaagccgataaacttcaatgaattgctattacgaatcaaagctttgttacgccgcgcaaaaattacggccgacaacttgttgatcgttggcaatctcactctcaacaacgaggcgattactgcacaagtcaatcatcaaacggttgatgtcacagttcgggaattccagatcctttataaattgctttcatatcctgatcacgctttttcccgagctgaacttatcaacgagttctgggaccttgccagtgataccagcatgcgcgcggtagatgtatacattacaaaactacgcgagaaattcaaagcagcagatggctttacgatcaagaccattcatggattaggttacaaggcggtgttaaccttatgaaatcagtaaatgagcaagccgttcaaccacaagtaaagcaacacttttcatggtttcaattctttggctccttctttaccttgagcattctagcagccttaccgggaatactttatggtaataattggcatctagtgttgacgccgttattaggctggtatctgctttactgggcattggtcgctgccggcttctccgcattcaccgcctggcagaaataccgcgcttttgacaagccacttaaagctttgagcgatgccgctgaacaagtagcaaatggtaactttgatgtttatttacaaccggttcatgcaccccagaattacgactacctagacgcgatgtttgctaacttcaatattatggtcgccgaactgggctccaccgaaaccctacgtagtgactttgttgccaatgtgtcacatgagttcaaacgaccgttggcaaatattcaaggttatgcccaagcattacaacagtcagggcttgaccggaaaacacagcaactttatttgaccaccattagtgattcggtcgcccatttagcaacgcttgtcacgaatattctaaagcttaacaaactacaaacccaagtcacggcacctgattaccaaaaattcgatctcagtgcgcaactgacgcgctgcttactggatgatgccaatgcgattgatgctaaacagttacatctaacaattgatttacccgactcactgccaattatcagtaatccccaact

SEQ ID NO: 11 - DNA, 1701 bp, Lactobacilllus rhamnosus
aagttcggtgagatagtctttttgctgcgtaatacgactttcaaaatttgtcatccatttagtcaaagtttcagcgtttaacatcagtatccccccagccaacagtgtgtgcagatgcattcagatagttcaaccattgcggatcacccggccaattgacgaaatgaaaaaacaggcgattcggatggcgcgtggggactattccggtcaggttcgagtttacgggcaggatgaacttggccagcttgcagtcgccgtcaataatctaagtgtgcgtgttgaagaagcccaagaagcctccgaagcggaacggcgccggttggatagcgtgttggctcatatgaccgatggcgtgattgctactgatcggcgcggtaatgtcatcattattaatcagaccgcgttgagttttctcaatactaaaaatgaggatgttattggcgtttcgattttgaagttactcaatatcgccaaggattatactttgcgtgacttacttgagcaccagactgaattgttgttggatttttcggagcaacttgatcatgatctgattttgcgggttgattttagcttgatccaacgcgaaaccggctttatttcgggactggtcgcggttttgcatgacgtaacggagcagcaaaagattgatcgcgatcgtaaggaatttgtttccaatgtgtcacatgaattgcgcacgccgttgacctcagtgcgtagttatattgaagcgttaagtgatggtgcgtggaaagattctaagctggcaccgcagtttctaaatgttacgcaagaggaaactgaccggatgattcgaatgattaacgacttgctgagtctgtcgcgtttagattccggtaccagtaagttcaaccttgaaaccgtcaatttaaatgagttcttcaactatgttctggaccgattcgacatgatgctcaagacggataacgaacacaccggtgaggcgcggactgcacaaccgttgccacagccggatggccaaaagaagcgttattcgattaagcgggaaattacccacgaagatctttgggttgaaatcgatacagacaagttcatgcaagtgattgataacatcatgaataacgcgattaaatatagtccggatggcggcgtgatcacagcacggttgttccagatgcacgatcacgtgattttgtccatcagtgatcaagggctaggaattccgcgtcaggatctgggtaaaatttttgatcgcttctatcgcgttgataaggcgcgctcccgcaaacaaggcggaaccggtctaggcttggcgatttcaaaagaagtcgttgaagccttacatggccgcatttgggtcgattcacaagaaggccgtggcagcacattctatatctcactgccatacgaaccgattaccgatggaggagatgactgggatgaagcttagtagttggattttgcgcgtgagtctgatcgccatggttattttaagcctcgtctttacgtcattgatttggcgaaatccatcgcggctggagcgtcgaagtacatcgaacgtgcaggtaacaaccgaaaacgatccgaatgttaaaaaaaatgggaaggcaacgtttacctgcctaaccaagtttattacacgcatcgtggtcaaaagcagctgctatttaaagccaatgccaatatcgaccatgaagttcaacaagcaatggcggattg

SEQ ID NO: 12 - DNA, 2458 bp, Lactobacilllus rhamnosus
ttagacgctggactcgcttatggacgactaatctggccactggcgttacgcactactttcattttagtcatcggaatgtagcccattttctggaccagtttcttctgaatggccggtgacatcatgtaagtcaaaaatcgtttggtcaaaccacttggccgaccttttgtatacatatgttcgtacgaccagatatgccagcgattcgttgccacgttactatcagttggtgcaacgccgtctacagacaagctgcggacggttttatcaacataagaaaaagcgacgtaagaaattgcccctggcgtactgccaacgatttgtcgcaccatcccggtggaatcctgttcctgagcggcaatcggttgcttgccttcaagcgcccatttttcaaaagtcgcgcgggtccctgaaccttgtgcgcggttgacaaggacaatcggcacattcttgccacctaactgtttccagttggtgatctgacccaaaaagatctgttgcaactgcgtcattgacacatttttcacaccgactttgggattaacaatcggcgcaatcccgacaacagccactttatggtccaccaaggcgttggctttaatgcccggtttttcttcagcaaaaagatcttgttgaccgatatcaaccgccccttgctggatatggcttaatccggtaccgctcccgccaccttggacgttgataaacacgccgagatgttccgtctgatattgttcgcccgccgcttcaaccaaaggctgcaaggcacttgatccaactgcggtgattgattcaccagactgtttcgaactatgactgatgccacatgcacttgctaacagcgccaaaaatacgatcgaaaacagggtcacaatttttttcacacgaaatcctccatttcaagctccaatcatcttaacagttgcgtgtaaatgttcatgtcgttgaatgtaaaggttctgtaaatatgtcatcagtcttgctgctggcgcttgctgatcggcaatgtcacggtaaaggtcgatccaaccccgacttgactcgaaacggcaacctgaccatccatacttttcaccagctcactaacgattgcaagacccaaaccagtaccgccattgtgacgactgcgcgctttatcaacccgatagaagcgttcaaaaatccgtgcctgctctgtctcgggaatcccaataccagtatcagcgaccgccaatgataagtgcccttcgactacttgggccgtgatcgtcacatgtccggctaatcgattataaaacacggcattgttcaaaagattccgcacaatctgagttaacttgcgctcatcggtcacaacctgtaagtctggtgcaattgccacctccacccgaatctgcttgtctttaatcactttagctaaattacgcaatgcatcgtcgactaacttcttaagtggtacttgtgcctgcaccgtttgattcgattcgggccggctcaacgttagaatatcattgatgagctgggtcagtcgcttactttcatcgaaaataatcttcaaaaacttatctagcgtcgccggatcatttttagccccgcttaatagtgtctcggcaaacccggaaatagcagtcaccggcgtctttagctcatgactcacattgccaacaaaatcgagctgcattttctcgacttggcgcaaatacgtgacatcgtacaaaataaccaacacctggagacgactagttccttggtttaaaggaatgacactggcatcaaccgacttttgggttgccaggacggtcaactcctgatgatgagtcttttcatggcgaaaagtgtgctcaatcatccgggccaacgcataagtcttaacatcgtccagataattgtgccgcggctgcggaatctgatggcccaaaagctgggacatggcatgattatgcaaaatgacatccttattggtatcaatcaacatgacgcctagtggcaaattatcaatcagacgatcaaaactggactgccgtactgcgactttctcacgtaaatgggtttgttccgcagctaaggcattaattcgccgtgccacaagcgtaaacggcgactgtggcggcagaatcacaggctcgggctcttttttctggcgaatccgatccgagtcatgatgaactgctgcaagaaactaaacagtgcgctacccaaatacagcaccaagacgattaaaataatctgtttgatcttatcaaaatcaattggatagttgccaacagcgataccggccttttgctccgcttggcctttcataacccctttaaaaatctcgggtgtagctttccctaggatttttggcgtgcgaaatttgaaagacggtccgaagccatgggccaaactagcaccgcaatataccaataagacggttgggcatggtacccaatacccggctgtggggccccaaaatttttcggttttcaacaaaccacca

SEQ ID NO: 13 - DNA, 2525 bp, Lactobacilllus rhamnosus
ttattcaattcgtccatcatctgggaacggccttggtctttagccatcaagttctggatcgggtggatatcacgcatcttgtcgtcaagtgcctgcagtgatttcacttcttcatctgtcaaatcctgtccctgcattgacttttgatgcatctcatatagctttggctggaactgctggaacaagccatatgcaacggcgtccaattgcaaaagatcaaacgccttcttaagatcttggaattcctgagttgtcttgatatatgacggcatttgatttgccgtgacatgaacgtttgccatgctgtacctcactatctgagcctatttgaaccagctcttagatagtatcataccattgtgccacagattgcttggcactgactatacctctatcgatactgtatggaattccttgccaagtgtcatcactttttcccggtgtttggatgctggccatttgggcggcatccttggtgtcaaaggcggtttgaggtgtattgggcatcagcttcgacatttcaagcttgaacaacggtgcgacaccggatgtgctggtaccttgcaaaaagtgctgactatccgttgtcggataaccaatccaagttgcattcacaatatccggcgtataaccaactacccactgatccttggtgccataaccccaactgctaggaacctcggtactgccggttttaccagcaattgtatagccagacggttttgccgttttcccagtgccttcgttaaacgtaccgatcatcatactggtcatttcctgagcgacttttttggacatgatctgacgcgttgccggatgggaattatcaaccaccgtttcgccgctcgcatcaacgattttccgaataaagtgcgtggtcggcagcttgccatcgttagcaaacgccgcgtatgcccgcgccagcatcaacggtgaaaccccgttttttaaaccgccaagagctgcggctagattctgatcactcgatttgagctgaatgccaaaacgatcaaggctggcaacgcctttttgcaccccgagtttgttgagtaaccaaacagcaggggcattgatcgaatccgccagtgcttgatacatcggaacggtgccaaggtatgtgccagtcgcgtttgtcggggtataattatttttgccgtagctaagcttttcgtctttcagaatcgagtcgtagtgatacccgttttctaacgccggtgtgtacaccatcagcggcttgatagtcgatcccggcgaattacgcagctgagtcgcgtaattaaaccctaggaaggtatgttcgccccggttgccgacaactgcgcgcacgccgccagtcttgggatccagaataatcgatgcgccttgaacctgtttaccatctgctgcattagccggaaatgcccagtcctgttcaaaactggtttgcagattctgctgataggtttgatccagattggtgtagatcttatagcctttattcagaatatcatcaacgctaatcccctcactgcgcgcttcttcgatgaccgaatcaaagtaagatggatatttctgtgcgttggcgtttgaaaaagcatccactacctgaaccgattgcgctttagctgcatttgcctgcgcctgagtcaatttgtggttatccaccattagctgcaaaaccacattacgtcgcgaaatcgcgttatctttatgatcagccggattataataactcgggttacgtaacatccctgctaaaatggcaccttcactggcatccagttgactcgcattcttgccgaaataacgttttgcagcgtcctgcacgccccaaaccccattaccaaaataggcattgttgagatacatcgcgagaatatcctgcttggagtaaactttattcagttgaattgccatgaatagctcttgtgccttacgcagcatggtctgcttttgcgtcagtaacgtatttttggctaattgttgcgtgatggtgctcccaccacccataatttgaccatgatggataacatagttcaacgccgaccgcaaaattcctttaatggaaaagccgccattcgagtaaaacgtccggtcttcggttgaaataaccgcattttggacttgcggactaatcgcactgagttcaacatacgtccctttttgaccgtacaatgtccccgcttcttcattgttggcatcgtaaataaccgttttggtctgtaaggtgctcttgatattttgaacatcagctgtttttgctttataagtgaaccaggcagagaagattaggatgaccgtcaacccaagtaaaatgagccagcgaatgacctgaaatcggcggaagaaccaccgaatgctctgccagacacgtgatagaacctgcatgtccttcctcctattatgaatcttatttattgtagcataggccgttgtcagccaagtctcgaccggctgtttttaagcaaactttatgaccaaacgaatcgaggaacctttttgttatttcaaacatccgccattgcccagaatcacgccagcctccg

SEQ ID NO: 14 - DNA, 7818 bp, Lactobacilllus rhamnosus
attcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaaggtaaacagtcaaaaagccctaaaccccccaagaaattatggcggcggattttaaaatggaccttgctcggcttgcttctcattttcattgccggtgtcgggttattctcctggtatgcaaaagatgcacctgaagtcacccaagcaaaactcgaatctggcggatccagtacgatttatgatcgtagcggtaatgagattacaacgcttggactggaaaatcgcgactatgtcaaagcttccgagattccgcaacaacttaaagatgcggttgtttcaattgaggaccgccgcttttacgatgagaaattgggcattgatcctgtccgtattctcggtgctgcttttaacaacatgaccggaaccggtgatggcttgcagggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatttgagtcttgcacaaacggctttcattgccggcctgccgcaaagtccggctggctacgacccttatgagtacccgcaaaaagcgactcagcggcgtaatgcagtcattgatgccatgttacgcgataagaaaattacggccgctgccgccaagcaagctaaagccacaccgattactgatggtttacagccaaaacaacaacagacaaacacaaccaccaatgataaagtgattgattcttacttgacgcaggtgattgcagaagttaagaagaaaaccggtttgaatccttacacggacaatctggatatttacaccaatattgacatgagtgcccaaaaacggctctacgatatcgtcaataccgatgattatgtcagtttcccggatgatgccttccagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgaacagtcccgcaacattccagccgtcaaaaccttgagtgcagttggtatgacgaatgccgtgaagttcttaaagggactgggtatcgacttacctgcctcagaacaatatctttccagtgcgatcggggcatcggtcaacacggttgaagaagccggagcgtatggagcctttgctaatggcggcacttattacaagccttattacgtcaataaagtcgttagcgccgatggcaacacccaaacatttaacagtcaaggaacccgggcaatgaagtccagtaccgcctatatgatcacggatatgctaaaaggcgtgttgacaaaagggacaggaacctcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccatttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcaaacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcggtttttttaccaactcctggtaatttgaccaagtcagctgcattggctggcacctgaccgtcatatttttcaactaaaatagcactcaacgcttttaaatgcgccgctttagttcgatataaaccaagacgactgatttttttggcaatatcggtgactgaagcagcagccattgccgcgggcgttggatacgcggcaaaatatttcgggcgtaaccggattaaccgcttcataccggtgtttgcgcccgaaagcttccatgtgcccttgaaatttgaaaaggaatttttcgcgtgtaatgtcggctgtgggtcaggatacaacgccataatttgctcgaacaattgtcgggcttctgaatcagtcacacaggttcccccttttaaaatcggtttgattatgaatccggtcttgcctaatagttaaagttcttgatgacgcttgagctcggcttgaacctgttgcgcggttttaagatgccgtcgttcccaattcagcaaaatgcgatccatgtacttcagtgaatacgcggcattcaaaacggcttcacgtagcgccaataagattacttctggcaagtagtgatccgtcgttaaccagtcgcgaatcgtttcctgttcaattggtgaaagtggtcggccaaattcaatttcaatttgattaaagacattcgtttgcgcatcggcatttggttgggacattacgctgctatggcttttttggtttgtcggtatcttcgccagcaacggcgtgagatcatagtggtcgcgcattttaccctgaccatccggaatgctttcaagaacaatcgcctgtttttgaatcaacgtttcaattgctgtatagattgcattgggtgcgacgttcatgcgcgctgccaatgccttaagatcaggggcttgatgatgcttggattgccactgatcaatgaacagatacgttataaactcggtttgggtcagtcctaacgtaggatagtcatcaaacagcagattagaaacattaaactgtcccgcttcgatgtaccgttttaaatcagtcatgataggaatcctccaaaaaaagccggcgcgttggcgtccgacttttggttgccattacggctttaggcgattgatcattcgtgggaatgggatggcttcgcgtaaatgatccaacttgcaaatccaggtaatggcgcgttcaaggcccaaaccaaatccggaatgcggtactgaaccgtacttgcgtaaatccagataccattcgtattcatctaaatcaaggccggccttttcaatggcagctttgagcttgtcataatcggtttcacgttccgaaccgccgatgatttcgccgtaaccttctggtgctagcatatcggcgcagacatattgctgctcatcttccgggtccgttaacatgtagaacggtttgatggctttaggataattcaacacaaagacaggctgatcaaattgatctgacagatacgtttcttccggcgagccaaaatcatcaccgtatttgacgtccatccctgctgcctgcaacatttcgattgcctttttgtagctgatgcgtggatatggcagcttcgtatactttttgagtacttccggatcgcggcctagcaaatgtaacggataggcgcagttatccaataccgcctgcaccatataggcaacataacgctcttgaacttttaaactctcttcttgatggcaaaacgccatttccggttcgatcatccaaaactcggtcaaatgccggcgggtcttacttttttctgcccgaaataccggtccgcacgtgaagactttaccataggccattgcccctgcttcagcatacaactgaccggattggctaagataagctttcttgtcaaaatagtcagtttcaaaaagttcggttgtgccttcaggtgccgaatcagtcaagatcggcgggtccattttgataaagccttcattgttaaagaattcaaacgtggcgcgaatcatttcgttacgaatttgttgaatcgcaaattggcgctttgatcgtaaccaaagatggcggtgatcgagcaggaactcaatgccatgctctttaggcgtaatcggatagtcgtgtgaatccccgacaagctcaatgttgcggacttcgatttcgtagccaaaatgactgcggctatcttggtgaatgacgccggtgatccacatgctggactcttgacgtaattcctttgccagctgaaagacctcatctggcacgtcggctttagaaacaacgccttgaaaatacgcggaaccatcgcgtaactgtagaaaggcaatctttccggagctgcgtttatcggttaaccacgccccaattgttacttcttcgttcacatggtccttttgcatcaataatgcgaatcttttccgtcatgcgttaactccccacttcaataattatttacaacaaactcccggatacgccgggcggcctctttcagactggccaaatctttacaataactaatccgcgcatgatccggcatgcccaaacgcccgtccaggaacaatggcaaccccggtttcggtcaacagtgcactgataaaatcatcaaccgtaccataatgactcaattgagcggcacgcttaatattcgggaaaagatagaaggcgccttgcggtttatctcccatatcgaaaccgggaatatctgccagaagatcatagaaaagattcagccgttcttcaaaagcacggcgcatcttttcaacaacctgctgatcgccagttaaagctgccaccgcggcgtattcggaaactgctgccggattagaggtcgtgtggctaataaaggtcgccatggcctgaatcagcttttccggaccggccgcataaccaatccgccaacccgtcatcgcatatgacttggagacgccggaaattaaaacagtattcgctgcgatatcgggatcgatactaatcattgaggtgtaagtcgtaccgttataaatcagatctcggtaaatatcgtcagtcactaccaaaatatgatgcttcagcgcccaattgccaattaaggtcagttccgtgcgatcatagacaacgccacttgggttttgtggcgaattgataatcaatgcccgggttttatcggtccgagccgcctcaagatcatcgacactgactttatgtccgactgccggcatgaccagatgtggcacgccgctcgccaatttaatctgttcctcgtaggaaacccagtatggaacaggaatcagcacctcatcgcctgggtttaagaaaacctgaaataaggcatacaaagcaaacttagcgccggtggttgcaacgatttgacgatgatcataacgaataccgtcttgggcaaatatccggtcactaatcgcctgctttaattccggaataccggttgctgccgtatagaaactggcattaccagcctgaatcgccgcaatagctgcgtcatcaatcgccttaggggttgaaaaatctggttggccaatagacaaatcaatgacgtcggcaccttttgcctttaagtctttcgtctgattacttaaggccaatgtcgctgacggtgcgacgttgaggattctttttgctaaatgcacgactgcgcctcctacagcttcggcaccattgcggctaccgaatcatttttaattataaatttttgatcgcgttcaattgttcgccgctgcgaaaactgtacgtcacgtagttcagtttaccagactttgacagatagccaatatcccagacaaattccgatcctcttttacccagtgatgcattcagaattttcttgggagcgctggtttgggtcacctgttgaatggctttttgccgggtaataccggacttttggtttaaaatcgttaccttgcctgtctttttctgaatcacgacgtaaaccgactgattcttcttggtttgaccggcaacggtgagataactcttatcacggttgtaccaccagaagccgttcacgttttttaaatcagcccgattggtagcaattttttccgcttggtcgcgcaattgttggtaaggtgacagactcttggcataaattccgatggcagcgatgatgagaacaatcaggccaccgataaataagaatttggcccagtcgaaacgacggtgatgacgcatcggtgctcccctccttttgttgggtatggttggttgagaattaggtgatgataagcccaatgctgttcgtaaacgcgctcacaggcctagaaacctgcgcataggggtcttgattccaaatggccaaagtgtggtaaactcgggcaactttttggtgtgttgaccgatacctttcgtaaacgcgctcataggcccagaaacctgcacataaagaccttgattccaaatgggccaaaacccgggcttttggaatcaaggccacttatgttccggtttctaaacgggcctgttcgcgctcttgcttcttaaccacatttctatgtacccccgaatatcggtgagtggcaatgtcattggttttatatttggtaaggatttttgcattttcttaccataccgcggg

SEQ ID NO: 15 - DNA, 7210 bp, Lactobacilllus rhamnosus
tggcgtttattttgcaaccaattacccttcttctggtacctcattcgcacgcgctttcttttttggttcatcttaatgaatgctgtggttattcttctaagcatgcaaactgccgggaatccacatgcgactattttctcactgttttttgatggggtgagttttagagccgcggaaacgcatcaggtcgtgttacctatattatggtttgcatattttttcgcacctttattaatactgctcaacgtcctccaacaactttggcacacccgcacgcttcatcttcggggacttcaaatcccgccgcggaaatttgcagaagtgaatctcatgcttattgccttgatcaccaccatttatgaagtcggcgctatcggtatcatggccatcgccgccgcttttaaccttcatttcggcagttggcaaggattggcagcagtcggcgctctttttgtcaccacttggctaggcgtcttcttactattattactccaagcgatcggtaatcattttagtccgtcattggcgctcatcatccctgcctgtctgctcatcgttagtgcttatacggccattcacatgaatccgcttggttacctcatgctcacacggatcaacgcaacaaacgcttggcaccccatccttgttctgcttggcatcagcagtttgacaacgatgggctacttagccgttgagcgtcacgccagtctaaattaaaggagaaacttatgggtttaattgaattacatcaagtggccaaaacaattaaacgccgccagctcttgcatcacgttgaagcaagcattgagcgtggcagcattacgacacttgaaggcattaatggctccggaaaaacattaattttaaaagcattgctcggtcttatcacggtaacaggccaagtcgtggttgccggaaagacggtcagccctcaagaagcctatccgattaaggctggcattttgatcgaaaatcccagcctgattgatgacttcaccgcaatgaaaaatctagaactgttggcccggctagatcctactatccaaccgcaacaactcgatgacctcctgatctattttgatctcacaaggtttccaacccaaaaagtccgcaaattttcgttgggcatgaagcaaaagctggggattgccgaagcgttcttaggcggctatccattaattgtcctagacgagcccaccaacgctttggatcatgacagtattatcaaattaattgccctgatccaacgcttcaatgcgaacgggtcaacttttgtcatcgcctcgcacgatcacgaatttgtcgaacaggttgcgactcagaagttatctgtcaaggaagggacgatccagcatgaaagttaaacccaagttctggatgattagcggatgtctggttgttttactcggtattattggcgtactgcgctatcaacaggtcaataccaacccgcagcaacgaggcgtcatcaaagaggtgctgattaaaaaaggccaacttgttcatgctgaaaatgtcgactttaaggttagtaaagttcaggttttgaaaaagaaagatcaggttatcgttcctgtgaccctctcgattaaacaaacaggaccggcaaattatggtcataaaaaggacaaccctaattacatcgaaaacatgtggttgaacatcccttatagcatgagcagccaaaccgataccattttcgataaaaacaaactcagggttaaaccagcgatgcatccttcaaccgtgcgccaaccattaaccttgcagttctcagcaactcggacaagttatgatcatcgcaaccaaaaaatgcgcttcagcttcctcgtgcccgttaagaattatcttgtgaagtattcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatcaagccggtaccgcccatgacctcgccatcgacggccacaccatcgccgccaaaaccggcacgggcccgaactcaagcagaaacaggacacagacggcaaggaaaatggtttcttagtcgccatggatgccgacaagaatacctacctcaccgtcgccctcatcgaaggcaccggcagcggggatgtcgtgacgggcaatgaagccttttgtggctagtttgtactagacacacttgctatcacattaaaaggagagaaatctcgatggacttgaagagatttaccgaagcgacctcaacggatatggatgccttcttcgccgagatgatgcaagactccagttacagcaagctagccaaatctgaaaaatccaagctggcaagcgcctatgctgttctagaggcaaggcgaaatgcgggattgagccaacaggaacttgcaaacaaatcaggcgttcctaagacaacgattgcgcgtattgaacgaggaaataatacaagcatcgaaacgctaaccaaaatcgcaaatgctttaggcaagcaagtaagggtctcgatagtttaattgataggccgctaacgccaatcttaaaaatcgcgtcaacctcccctttttgtgagaaattgacgcgattttagtctaactgatcttcttcggacacgattaaccttacgcaggatccattttaaccttcgccaaccccgcacgcacctcatcccccatcggaatcgacgggaatgcgccgagcttctggacagtaaacgagctggccatgctggcgtaagttgccgcatcgacaatattgccgagatcgggctgaaggttgctgactaaagcgccgataaaggtatcccctgctgccgtagtatccacagctttgaccttgaaagccgggacgagggttgcctgaccatccagcgaaatgaaagaccctttcgaaccaagcgtgatgaccaccccgcggatgccgagttgatgataatacgcggcggactggcgcatgctggcttcatcggtaaccggaatgccggtaatcaattcgctttcagtctcgttgggcgcgattagatcaacatttttcaacagcgcctctggcagttctttttgcgccggtgcagggtttaagatggttaccttacccgcagctttggcaattttgaatgcttcggctgtagcggctaccggcgtttccagttcagcaaccacaaagtcagccgattgaatcaagccagtcgcccgctgcacatccgctggcgtcagttcaaagttggcgccatgttgaatgatgatcgagttttggcccgatgcttggagcagaatatacgcctggccggtttccgtgtctggcgtggtcgcaacatattgggtatcaatttgatttttcaccaactcgccacgcctgaaagcagcattggcatcatccccgacgcgcccgatgaaattggtcttagcgccagatcgcgccgccgcaaccgcttgattggcccccttaccaccggcagctttagaaaaagcatccatttgaattgtttctcccggctgtggcagtcgttgaatgtgtaaaatagcatccacattgatactgccgataacgacaacatgattaggcataaagacccctccatttttccatttaaaagggaccgaatccggcccctttttttgtttaccttaccgcgcgacattgcttgaccagcatagcatgaagcttacttgttcgcatcctcggtggtgactaatgacagtggtgattcgatgttcttcttaatcgtcttgccgtcaaaatggtcataggctgcctgtagtgccaagcgtcccatctcttctggcttttgcgcaacggtcgcagccatgtcgcctgctttgacggctttaatcccatctgcttcaccgtcaaacccaacaatagtgatcttcttacccgcggctttaactgcctgcaccgcgcctagtgccatttcatcgttttgcgagaagataccgacaatatccccgttaccttgcaaaatgttctcggtaaccgtcaaacccttggcccgatcaaaaccggctgtctgcttcgacacaatgtcaagttgaccttttgccgcgccatcaaaccctttgccacgttcgcgagttgcggaagcgcccggaattccttgcaattcggcaatcttagcattcttaccgagcttttcaatcatatacttcgcggccatttccccaccttttttcgagttggaggcaaccagtgtcaacactttaccgccatcactggaacgatcaacggtgataaccgggattccggcatcattggcatctgtaacggctggcgtaatcgcactgaatcgactgggttgataatcaaaatgtcaacttttttctggatcatatcttcaatattgttgttttgtttagcggtgtcattttgggcatcggaaacctgaacattagttttgtttttcttcgccaaatcctgaatgccgttacgcacggaaacaaagaatggattcgacaatgtggacagcgacacgccgactttcagatccttaggcgctttcttggtaacttttgcatcaccgtcagacttcgaccccaaccccgtgttaccacaagcagttaaggtaaaaatcgcagcagcagcgataacggtgatcgtcaaaaagcgcttgaatgtgtgtttcatgttaattctcctcctatttatgagcgtaaacctgcacgactctgttctggcaaccaacttaaagtgcttaattcgcaaacctctgcctgcgatgaactacccattattaccggaccgccgatcgagtagcacggcgatcagaatgacgatgcctttgacaatttgctgatagaaactggaaatccccagcaagttcatcccgttgttcaaagtaccaataatcaacgcaccgattaacgtgccaaagatgcgacctttcccaccagccagcgatgtcccgccaagcacgaccgcagcaatggcgtccatttcataagaagtaccggcgtccggttgcgctgaactcagccgcgatgtgagaatgatccctgcgattgctgccattaagccggaaatcgtgtaaatcagcatcgtcacaaccttggtgcgcaccccggcaatccgagcggcagtttcattgccacccaaggcataagtcttccggccgaaagcggttttatgcaagagcacaaacaacacgccataaaccacaatcatgatgataatcggaaacggaatgccgaacagatagccgcggcccatgaactggaacaagaagctgttgttcattttcgcgccggtaatgggattcccatttgtgaaaacataggtggcgccgcggaaaatcgtcatcgtggccaaagttgcgataaacggagctgcttttccataagcgattaagacaccattcaacagtccaaacacagcgcctaa

SEQ ID NO: 16 - DNA, 1654 bp, Lactobacilllus rhamnosus
tgttccttggtgttcgttgttaagtgttgggcggtcacgcctttacttgcagcgaaaacatccttatcaaattctttgtgtgacgtcttaaccaacttcttgaaccagccattaccaccggtttcaaggttcaaaccattatgaaacacaacatcggcttcactggttgccgccacatcggttgggcgcggttcatactcatgcggatccgtgccgcgtttaacaatactgtacagcttgatcccctcgccgccgacattttgaaccatatcctccaaaatcgaattggttgtgaccacccgcaacgtttgattcgtgctcgctgaatctttttgagccgtgctccgactgttaatgaaccaaaagacaccaccgaccatcacaattaaagcacctacagtaattaaaatcttcttcatcgaataacttcctccgcggtttgagtcgtcgcggctgttttggtccgctgacgcttactgaaactaaagaatgcctgttttggtgaaaagacgaacgagatggcgaacaataccgccgctacgagcacaattgccggaccggatgcccagttaaaggtgaagctgaaatacaacccggtgatagacgaaatgaccccgacgcttgctgccatcacgagcatggtttcaagccgatccgtccataagaaagcagtggcagcaggcgtgatcagcatagcaacgaccaaaatgatccccaccgtctgcaaggccgaaacagttaccaaggttaaaaccagcatcaacgcgtaatgaatcgcagtggtattcaacccataagttttagcaaaggtattatcaaacgatgtgatcaacaattctttatagaacaacaccacgaacaagatgacaatccctaacacaaccgcggtggtcataatatcactatcgctgaccgccaaaatattaccaaacagaatatgatgcaagttcgtagcgctttctgccatcgaaatcaaaatgaatccgagcgcataaaacgcactgaacaccacgccgattgaggtatcggttttgatcttactatttgccgcaacaaagccgatcaacagcgccgcgataatgccaaacaccgaagccccaatcatgacgttgacacccagcatataagcaacggcaacccccggaagcaccgcatgggaaatcgcatcccccatcaatgacatgccgcgcagaataatgaagctaccaatcaaaccggacatgatccccaccatgatggcagtaattaacgcgctttggaggaaatcatactttcctaacgcagtgaaaaattcagctaatgaactcaaacgctcgcccctttcttgggttccaaccagccggttgaaaagatcggccgaaaatgcccgttcgatgttttgagccgtatacacttcttcgaccggtccttcagcaataatgccgtggttcatcaccacgagttcatcaaaataatttgaaactttatttaaatcgtgatgaacgacaatcagcgttttcccggcatcgcgccactgattcaaaatggccatgatttcctgctcgctcttcatgtcaataccgacaaatggctcgtccaggatcatgatgtcagcctgctgcacaatggcacgcgccacaaacacgcgctgtagctggccgcctgatagctgact

SEQ ID NO: 17 - DNA, 2945 bp, Lactobacilllus rhamnosus
atcaacacaatggttacgactttgatcaaagcaaaccataattccaattcgccaaacattcgcaccgaaatcagatttgccaaaacaaggaaggtgatcttccttcttctgtccattagcaatccttcgtagttcgtcaattgcatctcgtccttcttgactcaaccgtacactttcagtcgtgaggataaaatcaattcttagtatcatccgaaaaacatgccgtcgtaattcatagccatgaaaaccatcgcggataatctcttccttggttctttccacaacttcttcaatattcgtttggcggatgagctgcggttgttcatgtaattcatgcaacaggcagtcgatatagccttttgtttctaattcttcctcgtaatccatacgccgatcaccgcctttcatttgactaacttgatccgcatcgttttttatggtcattttcttaaataatgggcatcgccttttcgctactaaacaacaaaagcggtaaataccgatttatcgatggttaaacatcttatctgcaaagtaatcccaataagtctttgtgccggtgataacagatgcttggccggctaatccataataaagggactgccgctgcgatttagataatttcacccgcgccttgaccgtaaagaagttaccaactttcggatcgcgtgttggggcgacgtcaatcgcataaacccggccatctaatatggtaggggtcggcacattctcagcaattcgcaggcgtactttctgcccacgcttgatgctcatgatctctgtcggcgaaacgcctaattttatgtcagcaaccgtttgttccgttaaatccggcagaattcgtgccaacacgcttcctgaagggacgtattgattcccggccaaggcagtttctaaatgcaaaacgccactggcacttgctttgacatgatagttttgagtttcatcattcaaggtagctaacttagcctcgtctgcttggacctgttgctgaaccttcgtctgttccgcaacggctgtttgctgcaaccgactttgtaatgcggttagattagcctgagtctctcccgctttttgagccgatacatctgcttgtttttgaccggcccgttgctgctctaaagacgtcaaattggtttgttcctcatccaactgtgtctgtaattgagcaaggtactggcgtttaaggttcgcctgtgcctccgcgtcggtattttttatctcactttcatattgttgataaaggtagtgataggcgtggcgactgggcaagggtttgttcgcctgaatcgccgcttttgcctcggagatagcggccatttttgcttggctcgtttggatactggcgcttagtaaccgatcaatctctttgtttttttcactagcgacggtttgggttgcctgctcagcctctgctgtcagtgtcagcactcgccgttgactcagataatcttgcacctgttgttgatagccgaatcggtctgcctttgaaaaaagatctttgttttcggtaacactttgtttcaaaacatccaattgctgctgttgctcttttagcgttgccagttgctgcttgagtaatttaatttgtgttggattagcgacatcgtggtaaacaagtaaggtctcgcctttcttcacgcgcttgccttctttcatgcggttcgagacgatccgattggcggccgtcgcctgaactgtcacggctgcctttaccggttcaatttcggcagctgtcagcacagttacctcgcgccgagcaaagatcagaaacaatagcaagcctaagaaaagaatcgtactaggcataataatcatcgttgaaaaattgcgaaagcggtgctggtaatattcggtcgttgcaagttttttgggatccatcatctaaagctcacctcactcatgaaccaggcgcgcgtaataaccgtcttgggctaacaacgttgcatggtcaccttgttccacaattttgccatgatccatcaccacaatttgttcggttttagccgcaatagttaagcgatgggcaacaaaaataatggtccgatccgtcattgccagcaagcgatcgacaatttttcgctctgtaatggtatccagactgctggtcgattcgtcaaaaatcagtacttttgccggtgacaacaaggcccgtgcaatcgccagccgctgcttctgaccgcctgataaaatactgccgctttctgacaatttggtctgccactgctgcggtaagtttgcgatgtctgcggcaatttccgcagccaaacacgcctgcgtcaaatcttgttccgaaacatccgaacggctacctaacgtcaaattcttcaacaccgtgcccgaaaaaataaacggatcctgaggtacatattcaatatattgccgtaatgttgtcaggttaatgtctttgaccggaatgccattaaacgtgatggttcctttatcggcatcaaccgggtaaaagccaactaataattttgctaatgtcgacttaccagaaccgctcatgccaacaatggtatatttagcattttccggcacttcaaggttgacgtttttcaatacatcttggccaaaaccatatttaaacgagacatcccgaacgcgtatcggaccttcgattaaatgccgctccgtcaagtgccgctgttctttgaattccgattcgaccagataaacttcattcaggcgattgttagcaacccgcgccatttgtaactttggctgtaggttgatgatgctttcaagcggattcgtaaagtatgacagcagtgcattaaaggtcagcatctgccccaagctcatccgattggcaatcaccaaacttgccccaatccacaacaccacaacgttcaacgccagcttcaacagacctttaatcgcttgctgtaattgatctgccttggtgtaactaaacgatttcttcagataggttagaaattccc

SEQ ID NO: 18 - DNA, 1717 bp, Lactobacilllus rhamnosus
  misc_feature (1)...(1717): n = A,T,C or G
caagtaaagcaaggcaattgcggcgtacatgcaacatgcaccgagtcggacgtggctgttaccagacgtcggttccacaaactcgattttaactggggcaacccgttagaataaacctttatttcctaaaggaggaaattttagcatgactgttaagattggtattaatggttttggccgtatcggtcgtttggcattccgtcgtatttacgaaattgggtgcaaagagcaatgacattcaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagctgctgctaacacgattcctcacagcactggtgctgctaaggctatcggtttggttatcccagaattgaacggcaagttacagggtcatgcacagcgtgtttctgttgttgacggttccttgactgaattggtttccatcttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgatggtaagcttaattgaaacatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcgggcaaggcaattctgctgtcttacccttggccgggttaaaaccgaagaagataagggcaaagctgacccttgaagccctgtttgcagaaacgccctttagaggaatttgcctggaaaaaagccccanttaccttnttgttaccccgacttaccccgcgggttaaaagaaatttgggaaagaaccccgcatccggcaaagtttaaaaaggacg

SEQ ID NO: 19 - DNA, 843 bp, Lactobacilllus rhamnosus
agtcatggaaaaacgcgaatttaacattattgcagaaaccgggattcacgcacgtccggcaaccttgttggtacaagcagctagcaagttcaactcagatatcaacttggaatataaaggtaagagcgttaacttgaagtccatcatgggtgttatgagtttgggcgttggtcaaggtgccgatgttacaatctctgctgaaggcgctgacgaagccgatgcaatcgctgcaattacggacacaatgaaaaaggaaggcttggctgaataatggctgaacatttgaagggaatcgctgctagtgatgggatcgccacagcgaaggcctatttactggttcaacctgatttatcatttgacaaaaagacggttgatgatccttcaaaggagatcgaccggctaaagcaggcacttgatcaaagtaatgatgagttaaaggttattcgagcaaaggccgctgaatcgcttggcgaagaagaggcacaagtttttgatgcccatatgatgattttggctgatcctgactttacgggtcagatcgagtccaagatcaaagatgaaaaagtcaatgctgaacaggcattgaaagaaatttctgaattcttcattcagacttttgaaagcatgacggataatccatatatgcaggaacgtgctgccgatgttcgcgatgttaccaaacggatcatggcacatttgttaggacgtacactgccgaatcccgcattaattgacgaagaagtcattatcgtggctcacgatttgacgccttttgattctgcccaattgaacaaaaaatatgttaagggctttgtcactgacatcggccgaccgacaagggcc

SEQ ID NO: 20 - DNA, 7213 bp, Lactobacilllus rhamnosus
tgattccgtttcctgtttaatcaaccagagcgtgtgcagtaaaaaaagaccgtgcttatctttcaacacagtcttttttcatctaaaggaagcttcaactagtctggttgggaatcagttgttgccaagtctgccagtgcatcaaaaaagtaagctagactcagataatcggccgtaccacccggactaagattaaacgtgatcatctcagcatttaactgacgcaaggcatgaggcaagtgtgaatccgggacatgcaacaatgttttagccgcatcttgcacgaatcgtaatccctttggcccgccgcgatggaggacattggcatcttcaacttgggccatcaagtgcaccattaatcgtaaatagcgcatatccccgcgtctggctgtcttgcgtaaatatggcaagatcacatgccggatagtcggataaccagccaaagcctcacctcgaaccccagtaacgccgtgtttgacatataacgcttcgccatggctccagcgggcttttttctccaagtcccgaaaatcaccagccacaccttgcgtcacttgagccaccgtcgggaatagcggcgcaaagtcagcggtgactatttgttgcagggattgctgctgcatgagccagcccaatgcacccaataaaaaaccaaaggagaagttagccccacgatgcgtattaacaccagcagtagcggcgagcatggcattttctgctgcaatcccaatggtgcgtaattggcgatagagatcaggaaccgttttagcaacgacgccggcatgaaaatattgctgaaaaaaaggcgtcaaagcttcaatgctagctgcaaggtcgtcacatccatatcccggtgtgcaccatttgattcagggtcgaccaagccgggtttaggcgccaactgaacttctgcttgtaaactggtaactgccgcttgtgcaattgcttgttcattcaatatgttttgccttcataactttcagaatatagtgcagggaatgctctaagtgctcgcgcgtaatgagcttaatttgatcgtcatcttgattcaacatcccccgataaagcagccaatgttcctgaatggcaagattgcgccgatcatcgccattaatactgatgtcacgaaaataaatcaaataattctgcagctggttgacgatcattttcagccgcaacatatgactggcatcataaataaaattattaaattcagtaaacttagccatcacctcggcaacacgaccggctgcgttcaaacgatccgtttcttccaaaagagtccgcatctgattgaattgctcaggggtcatcagacgcatggccttacgcgtggccaacacatccaattccttgcgaatgtcaaaaatttcataggcatcgttaattgaaatacctttgacaagtacaccaacacccgttttgcgttcaaccagatcttcttcatccaaacgctcaagtgcatagcgaattggcgttctgctgatatttagattttcggaaagattcttctcgttaatccgctcaccgctgggtatttcgcccaaaaggatcgtcttacgcagcgcttcgtaaatcgcttctttaattggccggttctgtgacaaatccaaatttttcttaaccgctgacaccacttgattcatcgattgtcccccctcacctaacccaatattataccttaacgtgtctcaccacttaaaacatgctggctcacgctcacttaaaaagctgccgacaaatttgtcaacagctcaaattgtgctagcctaccaactcacggccgcgcgttaattgattagggggcgaaaggatcatgtaccttaattatgagtaggatcaaacgtcagcgaaaccttttgaaccggcacatcataaaacggatcttcacgccggcctaaaaagtcttttgcctgatcagggaagagcgcataactcaagacatcttcttctgaatgagcatactcggcaatagctttgcgaaatgccggtagttgcggctcaatcaggtctgccggtcgcgtggtgatgactggtgcgtcaccaataattttctttttcatctcaggagaaatcgggacaggcggctgcccataaagtccgcgaacatagtctttgatttctttagggatcagtttataccgttctccgctcatcacattcatcaaactttgcgtaccaaccatttgcgacaatggggtaaccaacggcggataacccaagtcagcccgaacgcggggcacttcttttaaaacatccccatataaagcctcttgtccctgatctttcaattgcgccaacaggttagaaagcatcccgcctggcacttggtaaatcagtgactttggctcaacatctttaacgcgggggtttagctgcccggcatcccggaatcgatcgcgaatcggcgcaaaatagctggcaatgtcactgacttcagctagtttgacatcagtcgggtagcctaagtcctgcaatgccacgagcattgattcggttgccggctgactggtaccgccagcaaatggggaaaccgccgtatcaataatatcagctcctgcgcgcaccgcctcaagatacgtcatttcagccattcccgcagtcgcatgcgtatggacctctagtggaaccgtaatttcctgcttaatgccgcttacaagatcgaaggctttctgcggggttaaaatgccggccatgtctttaatggcaatggagtcagcgcccatgtctgccatttcttttgccagcctgatgaaatagtcaatcgtatggaaatcactggtggtataactaatcgccagttgtgcgtgcccacccgcctgcttggtagcttccagtgcggttttcaaattacgtgtatcatttaacgcatcaaaaatacgaatgatatcaataccgttttcaactgatttcgtgacaaaatcggctacgacatcatcagcataattcttataaccaagcaagttctggccacgcagcaacatctgcaacttggtgtgcttgactgcttggcgaattttccgcagtcgctcccacgggtcttcgtttaaatagcgtagacaagcatcaaacgtagcgccaccccacatctccaatgcgtggtagccggccgcgtccattttatccaaaataggcaaaatatcacttgatggcatccgggtagcgatcaggctttgctgaccatcacgcaaaactgtttccatgaattggactttttgtttagccatgtgtggtccaaccctcctttatgattgcttcaactgccgcttgaacttcaggcaatccgtgtcgacgtgagcgcgcgcaggctttggcgtctccgccacaaaccaagcaggctcgcggaggtaacttaaaatcggtgcgcgaaacctgatgcagttcttcaccttgcaacgtgaccacatccaagtccagtaagtcacaaaagcgttgttgctgctcaaatccgatcattcggcgctttaaactaaccgggtccatgtgcaccgccaagtaagcttcagggccagttggtaacgattcgatttgcatgccttgcacgtttggttgtaattgatcctgcaaggcttgcatcgcagctgtaaacactgtaacgacgcgttttccggttttgaccggtcccggaatccgcaacgtcacgtgtaatagcgtcgtgtccggatttgcctttaaccagtcatactccttggtcatacgcgcatctttggcggccaacatttgccctaagtcaacttgggggccatccaaaactgacaatttaaacattgtgcaccacatcgattaaggtaccatcacgatattcaatcaaagcaaccaccttgtcgccatactgaatagctgcaggcgtgcccgtgatctgataggccatgttcttgagtgcttcaatcgaaaattgtggcaccttcaaatccttaaacatttcaatcagatctggccgggccgggttaatggccacgcccacttccgtcacaacaacatcaacactggctcctggggtcacaacggtattcacattttcgacaatcgttgggatgcgtccacgaaccagcggcgcaatgaccatgctcattttgcaggcggcacttgtgtcactgtggccaccggatgcgccacggatcacgccatcggaaccggtaatcacattgacgttaaagtccgtgtcgatttccaacgctgacaaaatagcgatatcaagctgattaatgaccgcgcctttgctcaacggtgacgcgtacatgttagcatcaatttcatagtgatcggcattttcaccaagcgagactgcagatgggtgatcgaagtcctgcacgtcgatcactttttcaacgagcccctctttcaacaattcaaccatggagttggtaatcccgcccaaggcaaaacttgctttgatattttgctgcagcatcgcctcacgcaagaagcgggctacggccaacgaagagccgcctgtaccggtttggaaggaaaagccatccttgaaataagcagatttcgtgatcacttcagctgcatattcggcaatctttaattccttagggttcttcgtaaagcgggtggcacctttagcaataccggtcgggtcgccaatcgcatctacttgaaccacatagtcgacatctgtttggggaatactgatcggcgtgttgggatatggcattaggctgtcggtaatggcaaccacttgatcggcatacttggcatcaatcatggcatagcctaaggaaccgcaagtcgctttgcctttggtaccgttaatattaccgtattcatcactacttggtgcgcccaagaacgccacatcgatatgaatatcgccacgagcaatagcgcgagcccgtccgccgtgagaacgaatgacaaccgggttttgcatgattccgcttgaaatagccgcgccaactttatcccgcaaaccggagctggtgatgttggtaaccacaccatttttaatgtgttcaatcagcggttcatgaacattggcaattgaactaggggcgatcgacaggtttttgattcccattttggcaatttcagccagtaccatattcatcacatagtcaccttcgcggaaatgatggtgaaatgaaatggtcattccgtcttttaggccggttgcgacaatggcatcatgaattgacgccactagtttactgtgatcaggcttgacgggtttaatgtggcgcgcatgttcatcataaggttgaatattggcaaactcgccaccgaaaacgccatattgatcggcaaacggctccgggatttcacgattaagcttattcttgaccatcagtctacctccattcctgacgccttagcgagcgcaatcgtgtattgagcacgctctaccactggcttgtcaaccatctgaccattgaccgaaaccacgccggcgcctttagcttctgcttcttttagtccggcaacaatttcccgagccttttgaacctcagccaaagcaggcgcaaacacgctgttgatgaccggaatctgccgcggattaatcacggatttgccatcaaagccgagttgcttaatcagctcggtttcatgacgcagaccttcttcgttgtccacctgcgtgtaaaccgtgtcgattgcagaaatgccggcttcacgggcagcatgcaaaataaagttgcgggcaaatgacaattcggcaccatcagcggaacgatgggtatgctgactggttagatagtcttcggcgccaagtgcaatcccgatcattcgtggggatgcctgggcaatttcccgggcattcaataccccttctgccgattcgatggcggccatcatatgggtcgtgccgtttttgataccgtactttgcttcaactgccgtaatgaccgcatccacgtccatgatgtcctgtgccgtttcggtttttggcagccgaattacattgataccgccaagcaccattgcctcaacatcctgatcgccgcctgcatccaaggcattcacccggacaacggtttcaacactgctgtaatcaaaagttttcaatgcagaatagaccagcattcgcgcggtatctttttcttttaacgaaaccgcatcttcaaggtcaaacatgatggcatctgccccataaatcggcgcatcacgaagcatgcccggattagcgcccggaacaaacatcatggttcttcttaatttatccatgcgttaatctcctcccagtcaaatgtcttgttgtcagcagcgcggtaagccgccgcaatggtgcgtgctttgatcgtacaatccagtgcacctttgtcattggcttcaaccgcaacgttttcgatcgccagttttgcaagtgttgctttgatgaccgcacgaatttgttcgccaaattgcttttcaacactgctttgcaactgaatcgtgataccgtcagcggctggtgcaagcgtgatttgaatatcacttgactccagtgtcccagccgtaccgggatgattaattttcatgggttgatcgctcctttatttctgtataaacctctggataaacgagttgttgcaccgttttccaatcctgttgtgcaatcgccgcccgaacccgcgtggcactaacaacttcgccagcaatctgcaagcgcggaacaacaatcaattcgatggtgtcaccaaaagtggcggctaattggcgattgtaaatagcggtcacgggtgacaatggctcttcaccgacataacgccgggtaatgtctaaaatgggggcaattcgctgtttaaaaagcgccgcatccaattcggcttggaccgacgaaatggcccgtatcgcctgtaccttggaaaataactcggaaacgtggtattcgacaccatgtaatcagcggttggcaacaccacgacattcgcccagcgtgaggcgattttttttacgaggcccaagcgttcggcagcggtgaaaagcgagcgttcggctgacagcacaaagacgtaaaccacggcattgtccctagctgcctgctcaatcagatacgcatgaccgcgggtaaccggattggcgttcatcacaattgccgcaaccggctgtcctgagtgctgatgctgctccaacaatgccgtgtagtcagcaaaattaggataaccacgttcgagcaaaaccaccgtgtctgttgccactaactgcttaaagcctaacgattcaaaaaactttttcgtgcttggcttggtatagacaaaactatgcgtaatcgtctcatcatccagcc

SEQ ID NO: 21 - DNA, 3193 bp, Lactobacilllus rhamnosus
tcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatcatccttgccggcgcgatgcagcagctgccggtcaatatgcttggtggctttgcagtgattctgacgatgggctggttgttagggacaattggtgccaacattccggtggttaagaatttcggcgggccagccatactgtcgttgttagtcccatcgatccttgtgttttataacgccctgaatccgaatgtgttaaaagcaactgacatgttgatgaagcaagcaaactttctttatttctatattgcatgtctagtctgtgggagcattttggggatgaaccgcaagatcctgattcaagggttgatgcggatgattattcccatgatgcttggcatgattctggcgatgggtgtgggtactttggttggcgtgttattgggtctggagtggaagcatacgttgttcttcatcgtgacgccggttttggctggcggcatcggggaaggcatcttgccgctgtctctaggatacagcacgatcacagggacgaccagcggcgcgcttgtggctcagttaattccggcaacgattatcggtaacttctttgccattatgtgttcaggtttattgaatcggttgggagagaaacgtccggagttatccggggcagggacagttggttcgactgaatggggcagaagatgacttggcagacgcgttgaaagaccattcggggaccgcttgatctaaaaatgatgggcgcaggcgttttcaccgcatgtaccttgttcattatagggatgttgttgcaatcagtgcccggatttccagggcccgttttgatgattgttgccgcggcgattctgaaatatgtcaatgtcattccgggtgaaacccaccgaggtgccaaacagttatacaagtttatttccagtaattttacgtttccgttgatggcgggactgggtttactatacattccgctaaaagatgttgttggcatgttgagttggcaatattttatcgtggttatcagtgtggtgctcactgtggtttccaccggtttcttcgtagcgcggttcctgaacattaatccggttgaaacggctattgtgacggcttgtcagagtgggatgggcggtactggcgacgtggctattctcagtacggcgaatcggatgaatctgatgccatttgctcaggtggcaacacgcttgggtggcgcgattaccgttattaccatgacggcgattctgcggatgatcttttaaatcgactagtttcgaaacttaaggaggatgattcacatggcaaagaaggattttaatcaactagcgctagatcaagcaaaagtaaatggcggaaaattgagtgtggaaccgaaagtaccaattgagacgcgcgatgatttgagtattgcgtatactccaggcgtcggggcagtttcttctgctattgccaaggatcagtcgctcgtttatgacttaaccactaagaaaaatacggttgcagttgtcagtgacggttcggcggttttagggttaggcaatatcggtgccgaggctgcgatgccggtgatggaaggaaaagccgctttgttcaaacggtttgctaaggttgatgccgtgccgattgtgttggatacgcaagacactgaagcaatcattgcggcggttaaagccattgcaccaacatttggcgggatcaatcttgaggatatcagtgcgccacgatgttttgaaatcgaagcacgactcattgatgagctcaacatcccgggtgttccacgatgatcaacatggcactgcgattgtggtgctcgccgctttgtacaatgccttgaaagtagcggataaaaagattgaagacattcgcgtggtggttaatggcgggcggctcagcggggctatccgttgcccggcgattcttggcagccggagtcaaacacgtcatggtggtggataaggtgggcattttagctaaaaagaacgctgatcaactgccaccacatcatgcggcgattgctaagataacgaatcgggaaaaccgcaccgggacgttagaagatgccttgaaaggtgcggacgtctttgttggggtatcggcgccgcacgttcttaatccagcgtggatcaaaaccatggcacctaaaccgattattttcgccatggccaatccggagccggaaatttttccggatgaagcgttggcggctggcgcatatattgtcggaaccgggcgcagtgattttgctaaccagatcaacaatgtgctcgctttcccaggcatcttccgcggcgctctggatgctagggcacgcaaaattacgatcgacatgcagattgccgcggctaaagggattgccagtttgataccggatgatgaattgtcaaccacgaacatcattgccaatgcgtttgacggggatgttgccgaagtggtagcagaaagcgttcggaacgcggcaaaagcaacagcgaaagcctagaaatcaatttagaagcctccttacaagatcggtgacgattgcgtacgggggctttttgcttggcgttatctataagaattaagacagatacacgtagattaggtgaaaaaggaatttgtcgcgtaactttagctgaaatgaacgttaaatgccgaaatccctacgtttaaatgttgttggatcatcaagcgggattgccttggggtcaaacggcttgcctgtatcacgggtgacgaaatgacttgctgctgccaagatgttgaggttttttaaacctaaaaagtacatcttcaacaatccgagtgcttccacatcgtctttgggaacctgagtctgttcgagtccatcgccactaggctggagcgcgacggtatcagtcaatggttcttctgacaaaacaatcccagccgcatgggttgaataatggcgcggcaacccttccaaagccaaagccgtttgaaaagcattcgattttttggcgaatccgcaaccagaatttttaatggctggcctctgttcgtatgcaggtttcaaaatacatatgaaataagttaggaatggctttacttcaaggatttgttttaaaattgacttaaggccaaaacccggcgcgaa

SEQ ID NO: 22 - DNA, 4159 bp, Lactobacilllus rhamnosus
atagttaacctttcatggtccgtttgctactactttcatcggtccatggcacagtttcatcagcttcattcggggaatagtgactgataacatcgcgatagaaatcaagtacccgatcgccaaaccgatcagcagaaattgccgccagcttttcagttcgcggtttgggatcatcataggcattaggatgcttcagataattcacaacttgatgaaccatttctgcttcagtcgtaaaagttgttcccaacgccggatcatccaacagttgatcagtataatcaccagcaagggcaacaacttttccgatcagcggccattgcctcaatataagtcagtccctgtgactctgaatcactagccgacacaaaaacatcgccgacacgataatagtcgcctacatcatcatggtcaatttcaccggtaaaccggacatgatcggcaatccctaattcagcagcctgtgcctctagatcttcacgtgcagggccatcaccgacaattaggagaactgctttaggaatttgcgccaaaattgcgggcatggcgctgattaatttatcaattcgcttttcataagcaacgcgactaagcgaaaccaataccggcacatctgccagtcccagcttttcccgtaagtgcgggtccttttgctctgcgaattgcgttaaatcgactccggttggaataatcttaatgtcggtcttaacgccataacgccgcaacgtatcatacacccgctcagacggcgcaatcacaccgcttacgtgatacagaaaagcgcgggtaaattgtttgacatggtacggctttagcagatgaccgtttaagacataatgcagataatcctcatacatggtgtgataagtatggatcgttggaattttcagttgtttggccacaaacttaccaatgtaacccattgagaactcagtttgtgtatgcacaatatccagatttaattccttagccactgcataagcgtgaaacagcccccgaaccgcaatacgccgatcagtaaaagaaacaaacggcacacttgtaaatcggaacaagttcggttcgaccgcatcatctggcacatgtgggtcggttgtcgtgaaaatataaacctgatgacccttacgttctagatcgtccttcaaggtcttgatggacgtcgcgacaccactgacttgcggaaaatagctgtctgtaaaaatcccgatattcacctgatcccctccagacgtcatttgtttagtataagtataaagataggcatggctaaatgcaattttctcacaaacctttaaaattatcttaccttgccatcagatgaacatcatccggcaaaagtcgtaaatttttaagcagccgcttgcgaaacatcccgacaatcagtcatttacaacctatcttttttgaagaaatatctattaattcatttatgaatacatattaacatcttcacttttggggttacttgtcacgctcgatgtcttccgctgcaggcattttaactttatcgttaacacgcgcggccttacggaagtacttcgatatgatatgactgttgatcccccagaaatagaagaccaccgcgccaagtataatgacgacaaagtccattggataatggatccagttcaacccattaaactcagcactgccaatcagcgaaattaccgagagaaaaaccaggtaaccaagcatccacgccgaggcttttaactgctgccaggtactgcgccaacctgatcgccattcataaaacagatacaacggaatccctaagaagataaccccaatgacttcaacggtggttggccattttgcccagtaagccgctaatgatgtcaacacaaatgccaacggtgccattactcgcaacatcgctgatttgaccggacgcttgaaattaggcgccatttcacgcaaagagatcaccgtgaccggtcctgtcagataagcaattaacgtagccgttgaaataacactggcaagcgtcccccacgatgggaaaatagagaccataatcatacttaagacagcattgaccaccatcgcgacacgcggagttccgtacttttcgtcaattttaccgataaacttaggaatgtgattgttgcccaccatcgcctgaagcgcacgaccggacgaggcgacaaacgaaacgccagttccaaatggcgaaacaaacgcatccatatatagcaaaaccgacagccagtgaataccaagcaaaattgccaaatccgcaaacggcgagttaaggttcaggcctttccaaccatgagcagcaagcatatcgggagaaatggtcgtgataaagacactttgcagcagaatataaataattccgctaatgagcaaagaaatcccgatgccgcgaccaatattcttttgcgggcgtttcacatcgcttcccatattaataacagtctggaaagcgttaaaagaaaagataatccctgaaaccgaagtcgccgcaaaaatcggtgcactaccataaggcatcaaggttgacaacgaatgcccataattttcggggtgaaaactcgacaaggccagcaaaacgatccgaatgccaagaatcgggttgtttttaacgaaatcaccaaagatgccgtaaaaaatgcatttaaaacccctcgtggtattgatatggatcttgtcgatgcgcaacaagcacgccgaattctcgatcggctcgtggggtactcgatcagcccgctgttgtggaagaaggtcaaaaagggcctgagtgccggtcgggttcaaagtgttgcgttaaagctcatcattgaccgtgaaaatgaaatcaagaactttattcctgaagaatattggtccttggatgccgaattccaaaaaggccgcagcaagaaattctccgccagtttttatggcatcaaaaacaagaaaatggcgctgaagaacaatgaggcggttcaaaaagtcttaagtcagattgacaagacgaagccgttttccgttaccaatgtggttaaaaaagaacgcaaacgtttccctgcaccgccatttaccaccagtaccttgcaacaggaagccaaccgtaagctaggattccgcactcgtaagaccatgatgttagcccagcagctctatgaagggattaacttaggcggcaagttgggtacggttgggctcattacgtatatgcgtactgattcaacccgggtttccaacgttgccaaaaccgaaacgagtcattatttgcatgaaaaatatggcgaggcttatgccgctgtcaaaattcgccaaggtaagcttcaagaaggggctcaggatgcccacgaagccatccggccgacgagtacgttacgaacaccggaaagcttggcgtcggttttagacaaagatcagatgaaactgtaccgtttgatctggagtcgctttgttgctagcgaaatgacgccggcgattattgacacagtcgccgtcacgctcaatcaaaatgacgtgacgttccgggcaaatggcagccaaatgaagtttgaaggctttaccaagctatacgtttcctcgcgtgatagcgatgaaaaggataacgttttaccaccgcttgcagtcggcgatgctgtgaagatgctgaaaaccgatccggcgcaacactttacccaaccaccggcacgttattctgaagccaacttggttaaggctctggaagaaaacggggttggccgcccatcgacgtatgcaccgaccatcgaaaccattcagaagcgctattacgtcaaactcaacgcccgccgctttgagcccacggaattaggcgaaatcgtcaatagtttgatcaggcgtctcgggataaggaaactcatcttcaaatttttgctgcagatcatcatccggcccgaaagcataacctttttccgcttcccgtttggcgtacaagtcaatcagctcgtcggcaatgtcttcgattcgagccgccactttgcgtttggtcttttgccactcggtaccgccaagcttattgacgttaggcgttttgccatctgcagaaacgtatttctgaaccagatttaattggtcaaccggaataaacagtttgtcattgttgcggtaaacgatggtgatgtaatcgcgatggacaccgtcaacttcaagcgtctccatgccggtatattgcccaatcccgtggttgacatgg

SEQ ID NO: 23 - DNA, 4784 bp, Lactobacilllus rhamnosus
aacgaagccaatgctgactcccgctctggcaagaccattaaaccggttttgattattgataaagactatgtaccgggtaagtaattgatcttttcccttggccctagctgtggtttgaattcaagcacaaaataataaagcaccaggaactccaacgctgagtttcctggtgctttattgtgttcagtcttccttgttttattaatctctggctttaagcggaacctcattgatcgaaactcgctcataatgagtcacaccatagcgcgtattataagtcaggcgcagtatttgtccgtcagagaaggggccgggatcatactcatccgtcttaaactcaagtagcttcccgcgcccagcagcatctttcgccaacgctcgataaacgtaacatttttggcgcagattaaccggaactgtcaccgaaaattggctgcgtggttcatgtacttttgcataataggcgacaccaccatctctgtacaccgtccaccaaagcgtaagcgcaataaccaccgccaatgcactcacaaagccaactttataaagtgtctcctctgtttcaatcgttaatcttctcaccccgagcatttcctttctgttttcaaaaagcaccttgatcaagttgaaagaaactgttcattgctatttaacaagtttgaaaataagcaacttgactgcgaattatctctagtattcagtcctggcgctccttaggtcaaagtaccaaaggaagttgtgtcggtaaattattcggttgtttttttaagagatttcttacacttataacaatatatgttattaatttggatggtatgttttatccggatttctgatgttagtaaaacattttttcaatatgactgattatgtgaggcttgaaagtatggtgactcccaacgtattaaaacatcactccgcagccgatgcctgaacatactcattcataatcgccgcgtcggcctttgtctccacattacccgcatagttcggtgtcaccaatgagacggtgccgtgtgcgttgtaaaacagataaaacttatctccaatcatgttcgctgcggtttgcgaatggctcccttcatcggtgaacgatcccactttaatctcggtgttgcatttgacggtccgcgtttggcctgcagcgtcagcactgaagaccttgattgttttagttgcaacattgcggatggtcgctttcatcgtgacggcatccgcatgttgatactgaatggtcaggcgataatttgctgtctgcgggtccgcttgcaactcaatccgagtcggcgcattcacgccttgtcgtgtaaaaaccgcccctgaacgttcccgcaaaagcttggcaacatcaacaacataatcttgactaccagctgttgactgagaactgcgcccccgactttcccccatatcacttggcttgaccgcactgcttttacttgcatgctgctttgaggtcacctttttgatcgcgctttgttgcgattcagtcagtccacgctttgtttgttgttgggcaatataaaaatagccgccgataatgaccaaccccaggatcaaaactgctaacggcgccatccactttctcttaggtggtcgttgacgccgtctgctttcactagtctgtttcaagtttaaaaacctcacttaattgttggcgttacgctgccttatcgactttgttagctcatagaaaaagtataacatggcgctttttaaacattatagttcggctcgtcagtacgcttggcaaaacaactaaacctttacagcatttttactgcacatatggtttgaaactttatactgaaactaatgatcatcgtctgtttgtctgcgcaaaaatcagtgtgttaggagcttggctgcagtgcactggttctcaccacgatgctcagattcaggcccatgctcactcacaaggaggttcttttcccatgcacaaaagttggtggcaagaagcagtggtttatcaggtttacccccgcagttttcaagatagtaacggcgatggtatcggtgatttgcaaggtatcatccagcatttggattacattaaagaactcggcgctgatgttatctggctcaacccgatttacaaatcacccaacgccgacaacggatacgacattgcggattatcaacaaatcatgccggagtttggtaccatgaccgatttccaacaactgttaaaagcagcccacgcccgcggtttgaaaatgatgatggatctggtcgtcaaccatacctctgacgaacatccttggttccaggcggctaaacaaagtcgcacggatccccatcatgactggtatatttggcgcgatcccgtcgatggtcatgaaccgactaattggcgcgcggattttggcggctccgcttggacgtatgtaccggaagtcggccagtattatctgcacctttttgcggtcaaacagcctgatctgaattggaccaatcctgctgtgcgcaaggccgtttttgacatgatgacgtggtggtgtgatcaaaggattgatggctttcgaatggatgttatcaatctgatttcaaagcctgatgtttttgctgatgatccacaccttttggaacagccaaacggtaactcgctgggcttaattgccaatggtccgcacgtgcacgaatacttacgtgcgatgaacaaggcggttttgtccaagcacgatcttatgacagttggcgaggcacccggcgttacgcccgccttggcacttcaatatactggtttcgatcgccacgagcttgaaatggtcttccagtttaaacatgttggccttgataacgatccacaattcggcaagtggtcactcaaacatcctcagttgaccgatctaaaacgcgtcctatccgattggcaaactgcactacacggtaaggcttggaacagtttgtattgggataaccacgatcaagcccgcgctgtttcgcgttttggggacgatcgccctgcttttcgggttcactctgccaaaatgctcgccgccactttgcattttctggaagggacgccttacatttatcaaggtgaagaacttggcatgaccaacgttgccttcccatccattcacgattaccgcgacctcgacaccctaaacgcttggcatgaacttgttgaacagcaacatgctcttgcgccagaagatatgttaaaaagaatccaccgtcgttcccgtgataacgcccggaccccgatgcaatggtcacctgcaccgcaagccggcttcaccgcaggcactccttggctagccgtgaacccaaactacacggacattaacgcaaccgctgcactggcagattccgattcggtcttcttcttttatcaaaaactcattcggctgcgtaaacaataccctgatctgattgtttacggcgcttacaccttactcgacccagacgatcctgatgtatacatgtaccagcgccacgccgccaaacaagaactgctcgtcatcagcaacttcaccgaccagacgttgactcgcgatatcgccaaacagctgtcaccttcagccaagctactcatcagcaactatgacgacgacgctgaaaatacgctccggccttatgaaactaaagcgtatttgaccagtgagcgatagtgagttcacttttgatctttaaaaaacgcaacgaatctcattcggaggttgtcaaaatcccgtcctcaccgatttttcttcatgtagaacgcgtctacttgccattacgtaacgatgcggccacatcaagataatcatcgtgatggcatcggttgattcgattctcttttaacggccgtcagccaacttgctactggttatcactagcttcaccgccaattagcaatagttgctggccgttatcggggacgcctcaatcgcgctttacccgtttcttctcccccgggggttctttatgcaacagtgctgttgcgttacataacataaatcattaaaagagaaacgcaaaatagttgccgcagttctatccgcaggcgccctacaaatgccaaaccagtcatggatatcatcggtgccagtggctgatcaagcgaaaggccaacaatgaaaggctatttagcatgccatcatgctttcaccttggatgaataatacaaataccatatcaccgtcacaatttcgtcacatctgctctgtagtattagcaacatagaaatgagccacccactcattcctatacaaaccccaacccaactttttcatttttactcctccaaagtagaaatcgtcagccggcctcccaccggctgaccaatacataaataaacccccgcagtgtgaggtgaagtgccccataattgttagacagatactctaatgattgtggggtatttttatgactaaatattcaagtgagttcaaggtgaaggttgtacaggagtatctttctggacgggtttcctataacagcctttgcactaaatacagtatcccgtcaacgaaaccagtccgagagtgggttaagcaagcccaagtccatggacttgaatctcttcagcgaaagcatacgaagacattttattctctggaacagaagttggccgtggtagactattatcaaaccagtggtgaaggtgtggcatcggtagctgctcatttcgggatcaacgcttcgcaggtgactgtttgggcaaagatctttaggactgaaggagtggctgggttgcgtccgaaaccgcgaggaaggcggtctacagtgaaacataagaaacccaaacaagttaagaagcttgagcttagtgaaaaggaagcttaccagcaaga

SEQ ID NO: 24 - DNA, 4351 bp, Lactobacilllus rhamnosus
ggtgccattttaagcccgcttgactgtagcctcgtcacccgcggcattgccaccctctccgttcgccttgatcgaatcctgcatcagcgaacgcgttatcgtgtttaaaatagtgtcgataatcttacgcccggttgcgggaaaagtaaagtgagcgcgaaccggcgcggttagaagtcggagtgtaagcggccttaagcgtgatggcccggttttggccattgcgcttaaggtccttacacgcagacttctgcgccggtgagcgcgttatgggcgtaaaccagaacgtaagtggccttaagcgtgatgattgggctttagccattgcgttttagggccttacacggagactgctgcgaacactctacaagttgttgcatcggaaaacaaggtggtacacttaaacataatgacttcacacggaggttcgagatggctgatttatggcggacgattgctgagcgccacggtgaattgctaagtgcactgggacagcatattgaaatatcactgattgcgcttattttagcggtggtaattgcgattccgttggcggtttgggttcagacacatgccaaagtcgcggcagttttgcttcagattaccggcgtgttgcagacgattccttcattggcattgctggggttattgattccgtttgtcgggattggaacattgccggcgattattgcgttagtggtctatgcgctgctgccgatttttcagaatacatatatcggcctgcgcgacattgatccttcctatgaagaagcggcggatgcattcgggatgagtcggttgcggaaactatttaaagtcgagttgccgattgcgctgccggtgatcttgtcaggcgtccggacggcgatggtgatgatcatcggcacggcgactctggcagcgttgattggtgcaggcgggttgggaaccttcattcttttgggcattgaccgtaacgatgccgcactgacactcatgggtgctctcgctgcggcgttattggcgattgtcttttcgtggttattgaacttgatgcaaaaaattaactggaagctgagcgtcggggttgtggcgttggcggttttcggactcgttggcacacaggtttacagccgagtgaccgcgccgaaagaaacgatcaccattgccggtaaattaggcagcgagccggatattttgattcatatgtataaggaactgattcaaaaagccgatcctgatgttggggtcacattgaaaccaaactttgggcaaacgagcttcttgtacaatgctttgcgaaccgataagatcaacttgtacccagaattttccggaacggtcttggctagtctgacgaaaccttctgcagcccaacagcagcaggtggcggcaggtaaagataattatccattagccaaaaaattgttggcccagcaaggcttcgcttatctgaaaccaatggcctataacaacacatatgcgctggtggttaaagcaagttttgccaagcgttatcagttgcaaactatcagtgatctggcaaaaatcgcaccatcaattcgtgctggctttgacttggaatttattgatcgccaagatggatataaaggcattcaatctcaatatggtttgcaatttaaggtggattccatggatgcctcgttgcgatatcaagcattagatcgcgggcagattaacctgactgatggctacacaactgacgcgcaactgcgacagtatcatttagtggccttgaaagatgacaaaggtctgttcccgatctaccgcggggcaccactcatgcgggctgcgtttgctaagcagcacccacgacttgttgcggcgttgaaccggttagccaatcacatcaccgaaaaacagatgcaggcgatgaattatgccgtgagtgtgcaaaatcaaaaagcggccacggtcgctcatcgctatctcgtgcaacatggtttgctcaaggaggtgcgctgatggcattgatcagtctggaacacgtcacgaagacttatgatgacaagccggttgtcaacgatttgagtctacaggtcgatcaaggtgaactgttcgtcctggtcggcacttccggcagtgggaaaaccaccacgttgaaaatgatcaatcggctggttgatccaacggcaggagtcatcaaatttgccggcaagccactgatggcatataaggtgcgtgatttgcgttggaatttaggctacgttttacagcaaattgcattatttccaacgatgacagttgcacaaaacatcgcagtcattccggaaatgaaagggtggtcacggcaaaaaatccgtacggcaaccgatgacttattggcaatggttgacttgccgccagccgagtatcgagatcgcatgcctagcgagctttcaggtggccagcaacagcggattggtattttgcgggctttagcatcgcggccgaaagtggtgttgatggatgaaccattttccgcgcttgatccaatttcgcggactcagcttcaggatatgttgctgcacttgcatcgggcaatgaaaaccacggttgtttttgtcacgcatgatatggctgaagcgatgaaactcgggaatcggattggtgtcatgcacaacggtcggctcttgcaggtggataccccggaagcaattgccacgcagccagccaatgattttgttgctgatcttttcaaaggagcgcaggcaaatcaagggttgcaggtgacattgagtcaattagccccatttgcggttgagcaatcagctgatcatgcagttggcggtaatttaacgttggccgaggcgctgccgttgttggacgcccatgaaacattgcgggtcaagagtgaccatggcgtcttcgtgattgatacgcatagtgtggtggcgtatcttgcaagtgcatttgttgatcaggacacagaaacgaaaggatgatcgaaatggcgtatgattatgacacgattgtcattggtggcggtcccggtgggttggcggctgcgtacggacttgccgccaagcaaaaggtactggtgattgaaagtgatctgtggggcggtacctgtcccaattcttgatgggatcccaagaagatgctttatcgcggagttgaagtcaaaaatgctgctttgcggatgaacggttttggcatcagcggcacggctaagattgattggccgtcactcatggccttcaagcgcagttacacaaccggtattccggccgggacgctaaccggcctgacacggactggcattaaaaccttatacggacgcgcccaattgctcggccaacatatggttaaagtcgggtcgcaaaacgtgaccggagaacatattgtcattgccaccggtcatacgccgcgttttccggatattcccggtgccaatttgttgaaaaccagccgtgattttctggacttggacgaattaccgactagcattgcgtttattggtgccggttatgtcagtgtcgagcttgctaacattgccgcggcagctggagcagatgtgcatatcattggtcattccgaccgacttttacgtgctttccctaaagttgccacagaggcattgaagcagctgttgcttaaaaccgggattcattttcaccctaatgttgaactgacaaaaatcagtccgcttggaacgatgacgcacttgcatgcagatgggtttgatctcaatgtggatatggcagttacggcgatgggccgaattgccaacgttgcggatttaggcttggccaatgccgggattaaatccgacctccgcggcattccggtcgatgatcacttgcggacggcggttgccaatatttatgcaattggggatgtcaacttaaaacctcaaccgaaactgacacccgttgctggctttgaaggccgctatgtagcccaacagattcttggcagtcaggaaccgattcattatccagcgattccaaccatcgtctttggccccacagagctggctaaagtcggcgtggcgcttgaagatgccctagccgcaccggaacagtatcaggtcacccacaacgagacaacgcattggtacacatacaaccgcattcaagacccggatgcgcaggtatggacgattgttgataaaagcaccggcaaacttgcaggcgccgttgtcctcgcgagtctggctgaagacctcatcaacacctttgccgctgcaattgatgccggtcaggaacctagtgatcaactggttgctcagttgcccaacggtatgaacagcagtgttgaagaagcaggctttggcttttccggtggggagcggcagcgtctttcactggcacggatactgttgcaggatgccccgattgttttgctagacgagccgactgtcggatta

SEQ ID NO: 25 - DNA, 7411 bp, Lactobacilllus rhamnosus
gctagtttgcatataatcattcacatgaattgagccatcatgattcattttaacctgaccaaccaacaactcggtcatcggacgaaaaccaacgcagacaactgccaaatcagcttgaatctcaccgtgatccgtctgaatgaaaacatgctccgcgtcactatcgaaatggcgtgccaccgtgttgacttttaattcaacgccatgctccgttaatactgaagaaatttctcgactaagcggtaaatccacataatggctcagcaacggcgcaactccattaattaaaatcacgtgtttttgattacgactataagcctctgccagttcaacgccaatgtagccgccaccgacaattgcaatcgtttcggcatctttggcactctccttgattctacgtgcatcatcataacttttacacatcaagacccgcggaacactcacaccggaaaccggtggaataaccggatagctgccagttgtcataatcagcttgtcgtacggataatgctgttgtgtgcctgtcttcaaatcttcagccacaatcacatgaccggcaccatcaatggataagacgtcatgttttaagtgaacatgcacgttgggacctaatgcttcgagtgaggccggcgttgcgtaaaacatgtcctccaaccgcccgaccgtgccttcaaggtacaaggcaataccacatgaaagaaaagagatgtcttcacgacgttcaaaaacatctacttcccgtttccgggtgcctcatcaacagttcgcgcactgccgcagttcctgcatgcgtacagcccacaacgacaactttcatcagcatctgccttccctttctagatggttaataaggacattatgacacgaaaacggtgaaacctaaagcaagtcgctaactgcttagggacacttccaagtataataaatttgttacttcttaatttatcatctcataaaggagcagatgcggcatgcacattacgcttatcggtgccgggccacgtggcttaatgcttttaggtcggcttatcagttggcaacggacccgttatccccagcgccaactcaccattttcctagttgatccgtatccaattggcggtcgcgtttggaagatcgatcaagaccctaatctcattatgaatactgctgcggcacaaatcaccttatttaccgatcaaacagtgacaggcgtgggaccgtttattgccggtccggacttaagcacctgggcgctcacgcttgctgccgattacctcgatgctcaccccgaaattaacaaccgttcgattctgatgcgccaggctgccaatctgggacccaacagctatgcgtcccgcgcgttgtacggcgtctaccaacagtggttctttgacttgcaaaaataccaagccggcaccaacatcatcacctataagcagcaaaccgtgaaccggctagataaaaaagctgccggatttaccgtcaccaccgaccaagagagctggcaaaccgatcaagtggtcatggccttgggaaatctaaaaaactcattgacgcgcgaccaaaaggcattgcacgattatgcgcaaacacaccagctcttttacctggaaccgggtttccccgaagaaggtgatctcagcggcatcgaagcacaatcgccggtcattattcgcggactgggcttgagtttctttgatttgatgagtcgtctcactgaaggtcgcggcggacaattccaaaaagcgccagacggtctgcttgtttatcatcccagcggccgcgaaccacatatttttgccggctcccgccgcggttttccttatcgtgctaaaggccgtaaccaaaagggaccgggtgaagaatggcagccgcatttcttgacaccacaacaaattgacgcttggcaaactcatggcgaagtgagcggtcaaaccttctgggaagccttaaagcacgaagccgagttgatttactatcggcttttgttgccccaacgctacccagaaattgacgaggcagcttttgaacgcgattttatcgccgaccctgttgcccaccttgggagcactgccaatcgccgctaaagatcgtctcgattgggatgctttggctgatcccaccaaggcgcatccaagcggccacccggtaccaagacttcatgcggcattatttgcgccaggatgcccaagaagcgatgcgcggcaccaaaaccggaccactgaccagcgcgcttgaagttttacgcgacatgcgtgatcccattcgccaactcgttgagcgtaatcttctcagtcaggatcaatacctggacttcttcttgcgctggtttaactcactgaatgattttctttcaatcggaccgcctgctttgcggattgaccaactgcaagcactaataggtgccggtatcgtcactattttaccgcccggcatgcagatcaaaggtattgacggccaatttcttttaaaaaccccgagcgatccaaaattttcgcttcaagccaaaaccttgctagaagcacgcgttccggcagtcaatgcgcccactgcccaaaatccattagtacagcagctgcttcatgacgggtacgcacacacttatgaactgcagctcaacgccgacaaacgcttccagtcaggcgctattgccattgaccgtcaaacccaacagctacttgaccaaaaagaacatccacaagccggcctcttcttctggggcgtcccgactgaaggcgttcactggctcaccactgccagcccgcggccactggtcaatgatgtgagcctcaaaaccgctgaacaaattgtcaaagtgatttttgggtgattcactggtatcgcgatatttgaatatcaaccaaaaagttcaggttacctcatcacaccagaggacgacctgagctttttcgtgcattgacatctgactgatttaatccagtttgctgaagattaatcatgtcagctcaatgacaatttatctagccgatctgaattagaagatataactttgccatccagctggaaaagcatcggtttgcttagtttcatttatgaacatttcagcttgatttttaaatgcaataaagaaatttgtcgcaccaagttctttttgaatggcgataattttttcgacttgatctttgtgcgccgccgtaccgtcctcacagtagatacaaagcgcctcagcaagtgcaatcagaaaccgttctgccatcatgccatcttcaacatgactatctttcatcactcgcaaatagtgtcttgctgtcgttagatctctagcagacaagtttacgattacaacgttgtataacaaattgataatcagctgaaaattttggtgaatctcccaagccacattaacttgagccgccaattcacgcgccagttgattgacagttcgcaaaggtaaagctgatatcgtattaccaaaaagtagcagttcaaaccgggtccaaccatctacatgaaagaggtagtccgtcaaaacgtcaatatccgcttgggaaagcgtctcaccggtcatatcagcgatcatagcattaaccatgattaaaataagttgattatattttcccggaaacgccgtaaaatgttctgccgcgcgttcccgcaccaattcagcttgatcacgattgttgttaacaactgcttttgtaatatccgctaatatcgactgctcatacaaagcctcctgaaacgccagtgcattcccaaactcagcaaacgtgacatggagacgttccagtaatgctaataatttagtagccgatatttgtgttaggtttcgttcgaacttagagagttgtgcttttgaaagaattccagtactaagatctgcctgactcattcctttacgttcgcgtaagttattaataacttccccaatatttttcacagtctgcctctttttcatatatgaaacgtttttaattaaaatcatattagcacatatacttacactatcaaataccacgatcgccctaagatgcaatacacaactttatcagaaaggctgatgtcttatgaaaccaacaattaaactattagcacatcaaaaactactgacgctactgacaacacttttgattttgattgaatcgcttggaaaggttacaagttctttaaccttggcaccactgactgatcaacttattaacaagaattttcggggtgtgtttttctggttattggcaactatttcaatttggggcgtgacgctgacgattgcttatgtcaattcgttgctgaaagctcagatcattcgcaaagtcaccaatcaacttcgaaccgatatcgcgaacgggctcaccagtattccggtttatgaatataataaggtcaaccacaatgaatatgtctcgtggttgaccaatgatatcaacatgatcgaacaaaatggtttacaaacattcttctcattgctaggcaatgctgcaacacttttatttgccattacttctttggccttctaccattacagtctagcctttgctgccattatcctgggcctcctcaccatgaccatcccacaatttttctcaaaagttatgacacacgaaacgaaccggatcgcttctgccaatagttcttttttagagaagtcagatgatatcatcggcggtttttcagtattttttagtcataacttaggtgacagattcacacaaaaactagcggacgcttctgattaccaaggaaaagaaaaggttcgctacgccagaaacgttgggcttgttaacctactcatcagcggcgtgaatgtcactgcccaaatgatcgttctggctttaacttgtctattagtcatcggtggctatttctccgtcggggtgatttcggcaagtggctcgttggcaggaacagtattcaataatttggctggcatggtgcaaggaatctttcaaatgaaatccgtcagcgtcttacttcacaagaacagccatttaagtcagttaccacgtttagccgaagatcggtcatttgaccatgcgcttaccctggatcacctctcgtttagctatgacgaaaagcccatcattaaagatgtttcctacacttttaaacgcggaggaaaatatgccatcttgggaaaaagtggtgttgggaaatcaacacttatcaatcttatgagtggaaggctaagtgattatcaaggtgcaatccatgtcgataacaccgaattgaaatcgctggcgacaaccgctttaaacgccaagatcgaactggtagaccagaagtcctatatctttaacgaaagcgttcaggaaaatatcacattaggggttgctaaacaaacgaatgcattaacaaacattgtaaggttcctaggaattgataagtttgctaatctaaccacaaacattcacgaacatggcagcaacctgtcaggcggccaacgacaaaagctagcgttggcacgggcactagcatttcacaaaccaatcctaattgttgacgaggtgaccgctgggatcgacaccgaaaatgcccagacaattgaagatgctttattagccaacaaggagcttactgtcatcatgattacgcatcatctcaccgaaaagactaaatctcagttgaccggaactctcgaattagcataaaaaacctgagttgagaaaaattcagttctcctattttccaacaaaaaacgagccgccaacttggcagctcgtttttgttcacaatcattgactaagcataacgcatcgtagcgccgactttagctgataaatgggcttcgggcaaaagttcaacctgaccgccgtggcctaatacaatgtccgccaatgtatttaacagattcgcatgctgagcggccttggaatcgcgctcaatctgatcaccttcaagccgcgcgtgaatgcgtgcgccggcttgaacaaagaggatggcgatttgtccacgcaatgccgccgacacaatcgttgccaattcatcggtgtaactgccattgccgcgtgcgttttcaatgacattagcgaagtgttgtcggcgccgatcacgcaatgtggcgcgcactggttcaagtaagtcatccagctcaacaaaatcaagcgttgccggacttttgaccactgcaagtttcggcagtaaatgatggttcttggaaatctcgcggaataccgctacattctctgctaagcccatgagaaccagcggcatttttttaggattcgaataatttgtcagtaaatattgatcaactgcctggtagaatcgccgttgatcgcttgccttctcggcggatttttcgttgtgcccatggtaagtgacgtggccaccgccttgagacacactatttaactcgccgcctcgaatttctgttccaagtgtgcctttcaatgtttgtggcgcatcgtctggtaaggaaaccgagcgcacttggtgaccatggttatggtatagctgaatactatcagcgttaagcgccagaatatcaaaatctgttgccgttgcctcatccagcatcaaaggcaaaatctgcggcacttcagttaccattgccacttcatcaactgcttcatacattggggttacatacgtttgcgcaccgttcgtcaacataccaatcccgtttgcttcgctgtcttgccaaaacatcggatcttgctcatatggttcaagttcggcagcatatggcgcaaagtcggtgtccgaataggtttccgccatcaccgtcttgacatgtttaagcatattcttgaaccggatccgcaacttctcaaccggtgtatgctccggccaagacatgtacagtgatacatacggaccctgtttggtatccgctaaaaattgctgcaacgtcggtctagtcgttatatccataaaaatgcaactcccttccggctgtagcctaccttagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttggcttcgacccagctttggcccattaagtttaatgcctagcttcttacacagattgatgttatctcgcgtgcgatagagagtatcgaccagcacctcatgcggatattcacccactaggtcaaaagcatggtcaagcgttacttcaagatcagtgctttcgttaaatgaattgaagtcgaaacgctctacatcaatcacgccatccaacatggaacagtcaatcttggcgcccaactcaacggactcttcgtgccttcc

SEQ ID NO: 26 - DNA, 2326 bp, Lactobacilllus rhamnosus
atgtgcgagtggcaatttattgccttctgcgcctgcaatatcttcaacgtcaccattgcgaaacggtactggcccgataccaaagcgctgcaacgggctgtttaacggttcaaccgtcaaatcgtagtcgtcaaagctgccatccgcctttaatgcaacgttgaaggcggggtggaaccctaacgcaaacggcatcgaattgctgtcatcatttgtcacggtgtaatgaatgctcagaccatcttcggttagcatataagtaacggctaaagtatatttaaacgggaactttttcaaggtttctgaattttggtgctgggtgaacgtcaccgctgagtcgctatgatcatttttggaattttgggagcggtagttgcttattttggagccaaaactttcgtcgcgccgaagtatgaatcagacacgtcattactagtaaatcggaagcaggataataatccaaatatgcaattgaatgctcagcaagctgacattcagatcatcaatacatataaagacattattacacgtccggtggttttgcagtccgtggctaaagaactgacaagtccgcaacgtgttgttactgaaaaagccaaaaaagcggtttatggaacgcggtataacgctgttacaggaactcgcgaacgttatgttgttgaaaaagcacaaccagccaaatataaattgaagcctgcaaaatattcaaacatttcttctgaggacttggcaaagatggtttctgtttcgactcaacagaattcacaagttttcacagttaacgtcaaagacaccgacccagtacgtgcacgcgatattgcaaatgaggttgcaaaagtcttcgaaacaaaaattgccaaaatgatgagtatctcaaatgtgtcggtagtttcaaaagctacggctaattccaaaccggtgtcaccacgattaaatatcattgcacttgcaggtctagtgttaggcgtccttctttcactcgtctggggattaattcgtgaactgacagatcagacagttaagactgttgacttcattacggatgatcttggcttagttaatttaggtgttgtgaattatgtgcagcgaatgagagatatggataaggctattaaagcaactaaactttcggaagatgacaacgtgcaagatattacagaacccggctttcctcaacggagtcggcgacgtgtctaaagggggaagtaaaaatgagttggtcaattaaaaaggtctttaatcggcataaggaagaccaggagacacaaaagaacggcgtaatgttagtggcctttgctgagccgaaacatgttgtttccgaacagtttaggacagttcgaacaaatattgagtttgctggagcagcattagataaatgtcaggttgtcatgtttacatcctctgcaatgtccgaggggaagtccactgtatctgcaaatgttgccgtaacttgggcgcaagctggtaaaaaagtcttattgatagacgctgatcttcgtcgtccaaccgttcacgcaacatttagaaaacttaatttagatggtgtcacaacaattttgacaggaaaaaataaaccggaagaagttgttgaagatacttttgtagacaatctaagtatgatttcttctggaccagtcccgcccaatccgtctgaattattgaattctaaacgaatgggtgaactgttggagtgggctcggtctaatttcgacattattgttcttgacgcaccaccagttttagcagtgtctgatgttcaagtattagttccaaaaactgacggagttgtggtcgtcgcaaatattggaaagacattaaagggagatttacgtcgaacagttaaagttttaaaattggctcaggctaaaatattaggttcagtcgacggggttaaagctaagcatggtgacagaggctacggttatggctatggttatgggttacggctaccagagccagaagtaaggaaaagtagtttttatagaacttgaagtgaaaatagatccccagtaccaagccgatgaaaaaaccgtaactcggtaatggccagtgggtcgtgataaccagaaccgctttagtagacaaaaggatcccgacgattgcgcctaagccaaccggggtcagaaagcgtaaatttttgcgcggattggcgcgaaagtgattaagtgcatttaagaggcgatcataaagcccaaccacaaccgcaaagatactgccggaaagtcctggaatgacaagtgcaatgccgataatggcacctttgatagaattaagcatgacatctccttatagatggatttattaatagacaaacacggataaggtc

SEQ ID NO: 27 - DNA, 13825 bp, Lactobacilllus rhamnosus
ataccaaaaccgggttataaccccgcccgttaaaagggggttgaatttaaaaacccccccccaatggggccgccacaggaaaaatgggaaaaggcctgggcccccctttaaaatttaaaccccaaatagcccccttgtggctatgttttaggttaaacccccataaaaggcccgggccccgcccagttttccaaaaaacccgggaaaaaacccccgaaaggttaaaaaccctttctctcctttaaaaaaaatgttccctggggcccaaatctatgcggtttacaagcccccaaaaaccaaccataaaatttgggataaatgcggtaaacttttatcccacgcttttgccatcccggttccttggaacaaacccattaaaaccccggctgcaaacaccaaaataaccacttgaacggcatcgccaccattagcgccgatccgtttgctttggtcgcctaacttaggatagtttgccatcaaatcgatacaggttccgaccaagaacaacaacaatggcggcattgcaatggctttaataaaagaacttgcccccaatcaggcaatcagaacaattgtcaaaaaaccgttaaacaagaacatattcgggcggcgaatttcagaaacttccggatccactaccgatgtcatttcgtcaattttttcatcggttaactcccgaactcccaagcgtttccgttctgcgcgacccatgtgcggtgccacatagaagatcacataagccagtgccaaaatcatccctggcaacaggtaggtcaaaatatccgcatcaacttttaaaactgccattgcccgtgcagttggcccaccccaaggcaataggttcatgatggtattttgcagaataatcaaaacacccaggttcatcatattcatgttgagcttcttataaatcggaataaatgccgagcaacaaatcaaagttgtggtcgtgccgtccccgttgagtgaaacggccatcgcaacaattgcggttgccatcagcactttcattgggtcgccttttgcaatcttgatcatctcgaacaccctgaggagcgaaacatcatttttattaccgggatcgggcaggtatttccactgattcgtgctcatcgagtcttgaacaccatgaatcaggttattgataaaacgcctgtcgttatgttttacccagggagctacaacagtttgagcttacgtgcttttggcaagcttgatgacaaaaactactatcgtgcatttcggatcgaataggaggacatggggaatgaaaattaaggatctttttaaacgaccaattgaccgcaacatccaaggggttattaaagttgatcaagatgacgaagcaaacgttaaacaggaactagacgagtatgttgttacgcgtgagttacgtgaccattttgcagcgttctttagtgcttttgataatagtttgcagaccccgactgacgatatgggtgtctggatttcaggtttctttgggtccgggaaatcgcattttttaaaaatcgtgtcatatattttggcaaacaaaattgttgatggaaaaccagcagttgattattttgacgacaaaatagacgaccagatgattcttaatgagatgcatgctgcggcggcggcaaacaatgatgtcattctgttcaatatcgatgctaaggcgaaagacacagttgggtcagataaacaaagcattttgaaagtcttcatgcgggtcttcaacgaaatgcaaggatttaccgacgccgatttttggattgctgaccttgagcggcgtctgaccgaagctggaaagatggatgcttttaaggagcaaattaaagcgattgatgccaatcatcagtcttggatagagttgcgtgacgcatattatctgaataaaggtacgatcaaggaagcaatggtgaaatccggattctctgacgaggcgaatgctcagggtttcattgaaacgctgagcaccgaataccagatcagtatcgatgattttgctgctttggttaaacagtatatcgacaaaactggacgccgggtcatcttcttggccgatgaggttggccagttcataggtgacagtgtacagcggatgcttaatttgcagacgattgtcgaacaactgggaacgatgacacgcggcaaatcatgggtagtcgtgacttctcagcaggcaattgacaaagtgacggacattgcatctggacaagacttttcgaaaattcaaggtcgcttcaaaacacgtttgtcgatgagctcggctaatgttgatgaagttattcgcaagcggttattggaaaagactgatgttgccgagcagatgcttgaagatcagtattctgcaaacgctgcagctattaataattcaattgatttcgatgatggtgtagagcggccaaaatataagtcgccaaaagattttgcacaaaactatccgtttattccatatcagtttaatcttctacaacaggtgctgactgcgattcgtgaaaacggttcggatggtaaacatttgtctgaaggcgagcgatcaatgctttccctcttccaagagtcagctgaagctatgatggatgcggacacagagacgcttgcaccatttagtcgctttttcgatggtttggaacaattcttggatcatacccatcacatcgtcctagtgcgtgcccacgacaatcctgctgttaatccgaacgacgagaagagtccgtttgcactgcagctgcttaaagtattgttcatggtcaagtatgttactgactttaacgcatcattgaacaatttgatcaccctgatgattagttcggtcgatgcagatcgaattgcacttaagaaaaaagttagcgatgcacttgaggttctagtcggacaaggttacgttgaaaaaacagtcaagggttatgactttttgactgatgctgaacaagatattacacgcgaaatttcgaaacaagaagtgattgacaatgaggttgccaaggaaattggggattacttgttcaatgccaagccaggtattgcaacgagtttaacttatcccaaactgaatggtcgctatgtctttgcttttaatcggaaaacggacaatatttttggcgcacagcgaaacaagctttcagtgcacatcattacgccagtgaatgatgaatttcagagtgacaacgattatttacaagtttcgactggtgcgtggaatcatgatgtcttgattgctttaccacgttcgtcaaactttgtcgatgaaattcgaaatgcattacgaattcagaagtttgttgttaatagcagtgcatcaagcgattcacgttaccagggaatggtgttggctcgccaatctcagcaaaatgaagagttccagcacgctcatgaacagttgatcgcatcgcttgataatgcagctatttatgaaaacggccaattgattaatggcgaagcagggttcgatagtcgattagaacaggcaatgaagctcttagttgacaatacgtatcgcagtttgcagtacatcactgttgccaaatctgagaaggatattcgcgaacttttcgaaagtatctccagcctggcgcttgacgagcaagacaatcaagctgcggttgatgctgttctggattatatgcggcgcgagtcacagaataatacgcatatcaccatggaaagcatcttgtcgaagtttaatgatattccatatggctacacggatgaagatattcaatggctcgtcgcaaaattggtcgctattggcaaacttaagatgttttacaatggtacagtaatagatccgctaagtggtgaacggacaccgcgtgaaattgcaggtttctttactaagaagcaagcaattcgtaatttggcctttcagattaaagaagaagttgcgccttcaaagatcaaagcgatgcaggcagttgcttctgaagtgtttggaaagaaatcatttgaggctgataacgatgaacagagagccgcagaactaagaaaactaatcgtgactaagtatcaaactttgaagacttttgaagataaacctcaagattatcccgggcatgtgttgttacaacaaggacttcagttactccgtccaatgactgaaatgtctgattctggtgcgttttatgattatatcagtaaacataaagacgacttactggactggaacgatgattttcttgatgatggcattcgtgacttttattactcgcagtcaatgcaagatatctgggacaagggtttaaatgcgttgcgcgtttaccgagagtcaagtgatttcttaagtgacaatcagctacaagatacagttgacaagatggcaaagttgcttcgcttgcaaagacttcagggcgatacagccgttaaaatcagcgaattaaataagcagtttgatgaattatttagtgcggcttttgataagacagcggctggttatttagcggacattgatgatttccgtgaacgtggcttgacacgtattgaagaatcagcgatacctgatcagaacgtgaaagataaactagctcatgattttgaaaatagaattaaagctatttctgaggcagccacagatgccacaaccttaaatgaggttgtagcaaaaccagctcaagctagtgcgcaattagatcaactgacggaccgaattaaccatgcaaaggcgcaattaataccagtgcctgaccattcagatgaggacaacactggcggtaagcataaggatccagataagcctgtggttcccaaggtcgtttcaccacaagagaagatcgtcaaactggaagaggttcttcacaagggtgactacaaaatcacaacctcgactgatgttgataagctaactgctcagtttaagcgctcacttgaggctcaactgtcagataacacggttgtgacattgcaaatcgattagtataaagcttgacagtcatgaaaggaaccaatatggataaaaaggcaatcaagacatttgcgattcaagctagacgtgatctgattaaaagtatcaggttaaagatggagaatcttggtatcacagaaactggtgttgaggagaaatcagcggcatcaaccaatgagattgaatattatggtgataaggggctatttatcagtggccaagatattaagcgtcgccgtgatttggtttctcggcttaaaacaatggccaagcaggaagaatggcgggacgcattttcggacctcatcgaagaagttgcgtatacatggtttaatcgaattattgccattcgattcatggaagtaaatgattacctcccgagtgacgttcgagtgctgtcatcggaaacaaagcttaaagtacctgatatcctgcgcgaagcttttaatattgaatacgagttaggtggttatagctcggatgagcgtgcaatcatccagaaagcccttgataccgaagaaccgtccgatatggatgctgcgtacgtcattctgtttaccaagcaagcgaacgcgctaaatcaatatctccctgaacttttcgaaaaaacagacgatttcatgcaattattgttcactccaagctattcggttggggtcattcgtgatcgtatgctttatctggataccgatgtcatttgtcggcggccgtttgctgcgttttaccatgagtccatgactggtgttgatattgccggtgcgttggaccactacggcaaatggtggtttcatcaccggttgatgtggtttgattatctcaattccggcgttttgctgatgaatcttgctagaattcgcgcagatggtttattagcgcgctgccgccagttgttacagcaacggtggctgtttatgccggatcagagtgctttaaataagctggccaagtgtaaacggattctgccgcccaaaatacaatgagcagcataagcttgagccggatacggtttttcagcactttacgacatcgtttcgcttttggccgcgttttcgcattgtgacggtcaagccgtggcagattcatgccgttcatcagcagctgggattgcatgaatatgatgatttgctgaaagattatcgccggctagcacctaaattgaaagaagtgtcctaaatgccaactccaaccacggttccaattttcttttccgtcgatgatggctacgttccttgtctggccgttgctttgacttcgattcgggcaaataaaaatccacgtgtcaattttgaaatcaatattcttaataatggcttattacccgccaatcaaaagcggttggctgctttggggacatccaattttgacattcgctttatcgcgatggataaggtcacgcgacaaatcagcggtgatacgaacaaactgcgcggtgattacgtgaccctgaccatttattttcgcttgtttatcgcggatatgtttccacagtatgacaaagcgatttatattgatgccgacacggtagcagaagatgacttgaccactttgtttgcaacggatttaagtgataacctggttgctggtgtggccgatcggccggccgggtgttggtgaccgagatgtaaaattgctgtttaacgatgccgatgtaaagccgcaactgccgcttttcgtcgggcggctgttcactgattgcttcaatggcgttatcgagtaagttccccaaaatcaccacgaggtcaacatctttgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaaactaggagctaaagtaaaactggatgacgccgaggtacttttctacaatggtgccgacaaagtaatggcgcgcattattttacaggagctgatgaagcatgattccagatctgtccaaggctaacatttacatcatttgtggccgcaccgacttgcgcaaaggcattgatggtttggcggccttagtgacagaggaataccagatggatgttttcgataatgccctgttcatcttctgtggcacccgtaaagataggttcaaggcgctgtactggaccaaaagtggctttcacttctgtataaacgctttgaaaactgctatatgcaatggccgcgcgatcgcagtgaaattcgccgcctaaattatcgccaaatgtcacgcttggtcagtggtttagccattgaagaacgacgcaccattcaagccataacgcccgggcatgtgtactgatactgcgaaaaggaagccttttctagaaatcaaagaaaaggcttccttttcgtatggccgcttgatatactcatttcaacaattttaacggaggatccaaaatgcctgctgaagcagcagttacgcaagcctaattcaactacctcaaacaagaaaatgaactgcttcgtgaacaagtggcatttctgatgcgtcgcctttacggtgcgaagcgtgaaagtctgaccgatggtcagctggatctttttgagaagaataaagctttctccgcaccagagccgacggaaccagaagcagctggcaagaagccagctgagcggaaaaaaagaaaaggcaggaaggcagcacaactggcgaattttcctgaagtgtctgtgcatcatgaattaactgacgccgagcgtcagtgtccaaattgtaccgccgaaatgcgtgagataggtgtcactgttaccagtcgtgaaccagttcgtattccggcacatgttgaagtccacgtgcattatcaacacgcctatgaatgtcgccaatgttcagaccaactagatcatagcgtcatcaaaaaaacccccttaccacagccgttcattaccaatagttttgcctcacccagcgtccttactcagacgatgatcgaaaagtttcgtaaaaaggtccccgtctatcgccaagagaaggattgggaagaggttggtcttcccctaacgcgtcaacaaataaccaactggcatatcttggcatgcgattatggtttggccgatctttatgaactaatgcatcaagaactgctcaaacagacaatcgttcacgctgatgaaaccagctatcgcgtcttagaaagtgaaaaggtgaagacctactactgggtattcgcatctgggcactgtgaggataagccaatggtcctttatgaacacgccgattctcgtgcgactgaggttccgaaacactttttaactggttataggcattatcttcaaaccgatggttatcaagtgtacgagaaactcgatcaagtcacgcgggttggctgtctggcccacattcgccgcaagttctttgaggccatgggcaaacagagcaccacgaaaagtgctgctaaaacgggggttgattattgcgggcgcatgttcacgatggaacgcaaatggcggctgctcacaccagaacaacgttatgaaaagcggcaaggccaactcaagaccgaaatgactaagttctttacttggtgtgagaacatccataccttaccgcaatccaaattaggccgcgcgattgagtatgcactcagtcaacgcgaagccctagaaaacgtcttgttggatggccgtctggagatctcaaataaccgtgttgaacacgccgtcaaagaactggttatcggccgtaaaaaccggctgttttccacgagtttcaaaggtgctcactcaaacgggattattttgagtatcatgcgttcagtcgaggccaacggacttgattgccgcaagtatcttgaatacttatcacaaccttcccgttccttgtgatgccggggcattacaagattatttaccatggtcgcccaaggttaaagccaactgttcgcgttaaagctgatttaaaaaaacggcttcggtattccttacagcataaaggatatcgaagccgttttaaatgtaccttacaatcgtacgagtactttgtaggtattgtattattgaggcttattgtcagattcccgccatagtataacaaaaaagactccccctttggagagccacactcaccgatagatttactctttaacaatgcttattattcgtaagtcaaaattttacgattcaacttttctcacgaataaacatacaattaaactgaatagagctaacttttaaaacaattaattagtacgcacctgtcggatgaattaccacaagaatggttttgaacaagatcctgaaatcttcagcgacactagcatgatttatatagtgaatatctaaagcaaccatttcgtcaaagccaagctcattacgacctgaaacctgccacaaacccgttactccaggaacaacagccaaacgctgtctatcatactcagtgtactttacaacttcgcggggcaaaggaggccttggacccactaaactcatatcacctcgtaaaacgttaaaaagttggggtagttcatcaagactatatttacgtatgacacggccgatacgagtaacacgcggatcttgcttgattttaaacattgcaccatcaacgtcattctttttaagtaacttgtcaaccatcttatccgcaccagcaaccatagaacgaaacttccacatctgaaaacgccgtccatctttacctagtcgagtctgtgaataaaatacctttccatgcggatcatctaatttaatcagtactgctaaaactaaaaaaacaccgctgagcagaacgagaccgataaaactggctgcaacgtcaaaacaacgctttgacactaggtaggtcggtgtcaatcccccaagattaacttgctcaacgtcggtccgtctatgttcagatgctgtttccaaatttacccctccaatatttcaaaactaaataataatcccccgaattccctgttcaagttatcttataacattcttgtggtacgagcaacaaaaacatgttacaaatctgttactatggaaagcttcaaaattaggaaaagccacactctcaaatgcatctaggcttgtaaatcaatgtctaagcaatccttaacttcagagtcactcattgttaaatattgtgattaaggcaaactaaagggacacaatgaaactttcaataatcacaatataagcataaactttacagttaggtggcatacgtctattgataacatttaatgttgtcacctatcttacatcactatactaaagtatagcaaaaaacagacaaactaccaccttctcgggcaccatttttaggcctttttaggcccttttttagatgctataatacacactttcattgacttttgtgaaaacttcctttttcaacagtagctcagctgctatcgctccattaaaggtaagtaatttcgcacaaaaacctgattcacggaaaatcaaattaatcttaaactaaacagggctctttaactttaacgcgttaaaaacttgggttgaaaatccatagtgcatttatttaaaaaagaacgtgagaaagtcgtttattcaagtgtttgcataaaccacttgctttttctacctgtttgataacgagacaagaaatactcccttcgaattccgaatacataaggtaatacagtatatccaagacatcttaacaaatcttaaccacaaaccatttaaagtattaggcagatacttcctcacctttcttaatcttaagataaatcttccaagcttttctatatatcggataactaaaaccaattaaacaaattgctactttatctcgtataggcgctttatgatcttctaaaactggttttcgcaactctttaatttttgaaattagctgttctctaatttcttgatagccatcaacattctgcatctgatttaaggtactgatgtatgcatatagcactcgacgttgagaagcgatttgaagatccggataaacttttttaacttcacatgccatctgttctgtcatatcaattaagtccaacttgtgaagagaaaattggtcattcacaatcgagttatatctgaatggataactatactttgcttctgaaccaacagcaatactgtccgaggccagaaacgtcttatatgttgcggcgatgtcttcaaataaacgccctttgggaaaatgaatttttttgaagacccaggcgggatacaatttcgcccagactgaagtatcaatttggtcatcgtacaataagcgcttaacagcagtatgcgaatcaagcacagctggtccttcatacaagttcgtctgaattttgccatttttgtaaacgtttcggtgttgacagatagacatggtagcattgctcttaacgagtatgccatacagatactcaatataatctggatccacataatcatcgggatcaacaaatgatatccattgtccccgtgcaacggatacaccaaaattacgcgtatctgcaaccccaccatttgtctttgagaagactcgcactcgttcatcctgctgagcattttttttacagattgacagtgaacggtctgccgatccgtcgtcaactaggactatctctatattgacgtatgtttgcgcaaataaactgtctatgcatcgctgtaagtatttttcaacattataaataggaacgattatagaaactaaaggcatatctgacataagcatttccaccttccatactctaccatgtggtaattactggtctttctccatctctgtctcatacgcttacttattccataaacgcaaaatacacggtaaatcgatatccgacttcgccaccagaattcgctaatagccgaattaaaagtcgaatatatagaaaaaaccgtatacacaactgtggttattttatttgcacaaaaaagcgtgcaaacactcatacctcgaattgtgaggtttctggaaacttattgttcaaagcttcgataatactattagccacttgctcttccccttttgatgccgcagtatcattgatacagagaacggaatgtatggacctttcgagatcatatcgaatcttctcatgcaaagtttgttcataatattgaacaaaacgtttagactgaggctcaaactcgttactttgtatttgccagtatctgaatacccaatcggttaagtctgaaggatctcgaaagtgatgagaagacgttgctgacaaacgttgcgcctcaagtgaccatactgcctcaaatgtcttcttgagataaggttgaggagtatgcggattaaagaatcccggaatggcgtgccacggtaaagctagcatagaacgaattaagtttttaccgtatttaagattaaacactttgaaaggagcacgtttaattagactcattttagaaaagtgatcgttaattaccatcatgttatttaacagtagatgactaaatggatcatccgcgggaattacggagtatatgccaaaatctttaacaatatcttcgcttacaaaaaagtctttaggtttgaccggcttattaataagcatgtcgtcattaaacaagataaactgatcacttaatccttgaatcctatgaagattcaataaaataggattggaactaaacgtcggcaaccactgttctggtatatagtcttcgtgttgaaccttaactaacttttcattcgaatagtccaaccagtctggccattgattatcagtaatcaaaaaaaccttattcacccaaggggcgaaacggtcaattgaacgaaaaaggtatttcaaaagtccactgtcacgatatctatactggccattgagctgaccgctcatgacaccactagcttctcctttattttcgaataatcgcctcttctcaagcagtacaggatcggccccatctacccaagggatcacaatgtcaatcttcatatttccccctcaaaatatcttcgtattcatattaagactttgatcatctcttataattaatcattatagacaaaagtaaaaatattgtaaatctgatttacaatttttaaggttcgccaacaaaaagccaatgcccttataggatttctaaaactgccacaaagaaatcaagtgaaagagattgactttgaacgtctattatttattttgttactttctgtaagctaaaggtaagtgtctaatagtattggctacggaactagcctgtcatttttgttcggtactccatcatccgatacaaaatcataatagttttcgatccatctcgaacttcaattaaaattagcacaccaaaaacggccaagagaaggtcaaaattggccttcacaatcgcaaaggtataccgtacctacaaacactgagttcctccttctatacttgttctatcaagcagattggaggatttttatgtctcaaaccaacgacatggtgcccgttaagatggttaaccgcgatggcgcttctgttgtcgtcaaacccaaactaggagccaaagtaaaactggatgacgccgagcgtcagtgcccaaattgtaccgccgaaatgcgtgagatgggtgtcactgttaccagtcgtgaaccagttcgtattccggcatatgttgaagtccacatgcattatcaacacgcctatgaatgtcgccaatgttcagaccaacta

SEQ ID NO: 28 - DNA, 5382 bp, Lactobacilllus rhamnosus
  misc_feature (1)...(5382): n = A,T,C or G
tcttattattagcaatgacccacacatccatgagcagctctgcaagaaagcccagagctcttttttcattgccttttagtttatcaaagttcagatttttttcaatgatacgcaatgtcgaaaaaagccacgaacaatagtcatcaaacgtctcacgtttcataataaacatgttaaacatgtgcgcagacgttcgtgataacacagtgttcagcgcgtcttggtatttttcaggaaattttgaaaaggatcttttcaaatgatcaattcttctgggtcatggctatggacgtaatgactttcaatcgtttcaatgtaatatctccgttttattggaagtacaacatcgcctttgctaagtaacgccagaacttcttttttcttgagcagatgactgaagtctttttttaatgtcttcttggaaacaaaatacctccgataatggttcaaaccaataacgtcagcatcggagttcttccacgcccagtatgtggctgttagttcgttaaagtgggaattctcagaggaaatattatcacccgtatcatcagattgaaaaccatctggaacattatgttttgaggcagccccaacaaaaatcggatcatatatctcatcattatttggcattttatattgcttatgactagctattaacatttgaaccttcatttgataccctcattttcacaaattgtcactttacttccgccacaacttcttgattatattgattcaaaaaaatatttggaatatcatgaactctgttgccatcttgagcttcattaacatatttatacgccactggcactttcctgtctgcattcattaacatccaagaatactctatatcaagatgcccaatatcaagaacttgtgcagacgttttgagatttacatcgtttgctaagattgtggcagtaggacccaaagagataagaattaatatatcaggatccttaagcttctcgacaatacgaacaataacatctaaaatttcatcgtatcgttcaaaagcattttcagaaggacagacaatccttttaattgatgcggcattcttcaaaagatcgtttccaataccaaatcgtgtctgagaaccctcaaccagcaaaacagttcgaccttgccatatttgtttgattagattaaagagctttggcccttggcttctatctttataaatcatatagggcctagtcagaagagagtctagatacgtttttcgaggatccaaagtacgaacccactgatagccatgatgtcctaattgtccggcccaaaagaatgcatcaagccgtctatattgtttcaatccggaaaaaatgtctggaatgcaaacttggaaccctctcctatcagttcgcacgacttccaaaagtgcggccgccaaagcgggagaattcttttcaaagttatcaggttctcgttctttaaacatccatttaaattcgccgtcaccaaacctactgatcgatactctttttctgataataatttggatcgactcttcgatcgaccgtactttaatctgttgatgcgtaaccagtaagtatagacgaaaaatagcataggctaacagctttacccatccaaaaattgacatcttaacttcacgtataaaactggtcttatttgtcaatctcattctccaccattttattgtttggatacttgatttcgggattaaagaaaaagccattccatgtaccaacaattgcagcttccaaacgacgtaatcgatggtcctgtgcagtgatgcaggtaagacctgtaaatacgttcgaaagaaccatcttggtaacatctttctttcgaccataaatgcgtttgacatagattaagttgcgatacattgatttgaagcgccaaatacgatccgcctgaatcgtcttcaagttatctgccattaaattgtaacctgttttatgaacaacaatgctttcactaacaaagaaactagttttagcggcagatagccttgttgtgtactcagtgtcatctccccaaatctgcatactgcctaacggaagacccagtcgcttgatgttgaccttagggactagaaccgaaacgaaagttgctgaaacaacgcccacaagtcccatatctatcttatcaggccaatccgtggaaacgtgcgcaatgtttgtagcgcgtccatcagtccacctgacattagaacagagaaatccaaaatcatcctctaataaactcgccttttctaacaaagctgcggaagcttctatatttggaattgtgtcatcgtccatgatccaaacatagtttccactcccttcacttgaggctttattcaccccgtattcaaatcctgcagccccgccgatattatcatgcagcgttgaggtcttaattagtggatctttaatatgttcaagatattcagtggtgccgtcagtgctgtaattattaatcacaaaaatggagcttaagttttctcgctgattcagtagcgctttaagacattcctttaaaagcggcagtcggttgtaagtgactaccaccgcatcaatcgagttttccatccaatccccccaaaactataccgattaaacgtcgatcatttattcctgaattcgattccgaaactttatcattgtatctattgtaaactttctcgcaaaaaaataatttgggtttgctaccaatgccagatcatctgaggttaaatatcgcggcgttagattatgctttgatttccacacaaaatcaacatacctaagatttgcagacaatgttcccatgaaccgagtatttgaaattaaactttgaatgaacaattcatcgcagcaatacgtataattgaaatgttttatgatccaattttcatgacccaatatataacgcgctaaatcgtccgtaatactaaaccactgtgatccagactgtactgtaatttttctagctctattgatgcctatatagcgttgaaagtaacagaaagaaaagtcgatgtacttaaaaatgttcctcttccgtcccacaaacttatcttgaagaaaatgatactgttgataccggagtcgatacctatcaggattttgtctttttaaacggtcacttacttcaagaaaatttgtccccttatttcgtctaaaaaactcattgatttcaagattggtttttagaggaaagtcttcacccgagagtaggtggtaatagtcgtattggccgcttgatgtagcggacttcaacaagcacagttcaattcttactaaagaaaatccccccaatttccttttatcctttcaacgaagcggattcttgaaaacttaacaacatttttgactttaagttcatcaaaggccccagcttttaagtcaatatgaataaaaaagtcgtgtctcgggtcgtcaagttattttaaaatctgcaatagcttatcgttgatctcactagccatgattaaaaatgcatgtttcacagtccctctcgccctttctccctacaacagcatttggcttgacagtctaacaaaaggctaaacaaattgttagacataacaaggaggaataaaacataatctcatatttaagcactccaaagttggaaccacctgtagacgaacaggatggcatttgtacctatacatgtaaaatcccaaccctctcggattttaacacgatctctgttacttttcctttaaaaaagttttgtttgttaaattacctaaggcctcttaaagatgaaatcatttgcaataaaatttttggacgaagtatgactaacgcaagcgtatatatcaaagctccatacattgttgcgcctaacaaagcgagaaagtttgacaacggtaatacattgataaaaactcgtacgctaactcccattaaaagcgcggcaaccaaatacttccatacttcactaaaaagcgacctgatccgaagttggtttctcaccttacttaactggtaaatagaaaccaataactccgatagaaccgttgcaatcatcgctccattgctgccccaaattaagatgaagggcacattcaataccatgttggcaacagccccaaaaacaacagatgtcgtaaacggtctaagctgattagttggtagtaagtattgaaccccagtagcattactgatgccaataagtacaataactatcgattcgatcactaataaattagcaaccgggtcgaagccctttccaaaaaagattttcgtgaatattggtgcgattccggctaacccagttgtcattggaaatgcgataacaagaatgaagtgcatagatttattcaatgatgcttcaacctcatcatgttttccttgtgcaaaactatgcgccgtgtgcggaagcaacactgtccccgtagctgtcacaactgcaagtaatattttgacgatcttgtctgagttatcatagaagcctgatgcctgaaccccaacaagggctcccagcattgtcttgttgacttgtagatatacttgtgtcgcaatctgcggaacaaacatttcgattgtcggacgtaaatgatcaatgactttcaaatcataccaatgcggcacaacaacgtatttttttaaatatggtactaatgttaggttccccagaacttgagaaccagtaagaattaggatgtagagccaaagatcgttctttgttcggacaaggacaaagatcagtatcagcgaaatgatcttaaccaaagtatttcttaacacggtaatacgaaattcttcaagaccctgaaaaagccaagatacatcaatcgctgtcgctaccagcaaaagtccttgaataagatagaagacttgatattctcctgacagcaatatgaagcccaaatatagcagcgtcgcaatgcctgtcgtaacaagccttaacaaggttaattcccaaaacaaacctgataaacgtttaggattgtcgcgctgataggctacttcgcgatttccatacattgttagccccaatgtcccaaatagaacaaaatactgaacaatcgaattcgtaaatgcattgatgccaattcctgtcggtccaagaactcgagaaacataaggaatagtaacaatcggaagtaaaagaatgaaaatttggtaccccatattccagaggagatttttgactattttagtgatgatccacttcatttcgacggagtatcgcagccaaatgaaaaagccaagtgatcactcacttgcttttgttgtaaaaaaagcttcgtttaagaaattgtaatggaagtgtgatttacttgatttggagtaatcatggnnntcnnttnggtggtgtttcantgttttcaatgtttntttatgtttcaatttttgacatataggtttttaattaaaaataattttatgttatattatttgatatgtggaattttgtatgagattattataa

SEQ ID NO: 29 - DNA, 1504 bp, Lactobacilllus rhamnosus
ttggtgttactggtgcacttgttcaggtaaatcattttagcttaaatcaaaatgttcaaatgtaataatgctccaatgcagtaaacaaaaattcaacctgtcacttttttaacacgcactccagcttgagaaccttttgataagcactttgttcacgatgagcaacgttcagataactaccatgaacaaacttgactatccactggcatcggctggagaattcaagttcatattttgggaggaatcgttatggtggagttacaatcagttaaagatgaatcaccgttaagtcgcgcgttacaagacgagcactataacggcgctgtcgcagttgtttcacccgataaggaattagcggcggattcacaaggcttttcacacattgatatggcagtaccgtttgcctcacatacggtcagcggagccggaacagtcacacaacaattcttcggcattttactcatgcaattcgttgaaaagggagtcgtcaagcttagcgataaactgtctcaatatgttcctgagtatcacaatgccgaccagatcactttgcaccagctagcgaacatgcaaagcggtatccctgactaccttactttgatggcaaagcccttcaaggagaacgcacctgccaccttgccagatgaacggttagctttacaaattgatcagcacaatgctactaatatggatttcgctaaggttctggatgttgtcaatgacgtgccactcgcttttaagccaggcagccaaacttcttatagcagcaccaatgcgattttaataggcgaagttcttgatcgactgacgaatgaacgcccactcgaagcagttttgaaggaatacatctatgatccactagcactgaccaacactaaacttggcaccgcgcacgcatttgcggaaggttatcactggattgccggcaatccaaacattgcaggaaaaggtgatgaaaatcaggccgatcgcggacttgttacaaccgttgatgatctcgaaaagttcgcacaagctgttttgactggtaaactgctacaatcaaccagctggaaaactatcttcaaagatgccgagaatggctatggatttggttggcataaattagaaaacggctggctaggtaactctggcagcatgcttggatatactggtctgctaagtatcaaccaaaagcagaaaaaagctgtcgtcggtttaacgaatgtcttaaaaccgcagccggccatggatcagttctttaatacgatttatcaagttgcgacaactttatagttttcaaacagaaagaagccttgattgcgtttacggatgcaatcagggcttcttgacttttattgtcgtcgggaggagactggcaacgaattaaatttacactgggataggagtcgttatgacattttggatttttatctacttaattgttgccggtatttttggcggtttattagcttccattgctggattggcctcacttgtttcatatcctgcttgctctttgatc

SEQ ID NO: 30 - DNA, 2726 bp, Lactobacilllus rhamnosus
aggttatcgttcctgtgaccctctcgattaaacaaacaggaccggcaaattatggtcataaaaaggacaaccctaattacatcgaaaacatgtggttgaacatcccttatagcatgagcagccaaaccgataccattttcgataaaaacaaactcagggttaaaccagcgatgcatccttcaaccgtgcgccaaccattaaccttgcagttctcagcaactcggacaagttatgatcatcgcaaccaaaaaatgcgcttcagcttcctcgtgcccgttaagaattatcttgtgaagtattcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatcacccaattgacattcaagtcttgggtattggccgcaatggtcacattggcttcaacgaaccaggctcaccatttgatgccgaaacccggaaagtacctttaacccaaagcaccattgacgccaacgcccgcttctttgaaaacgaaaacgacgtaccgcgctatgcttactccatgggtattggctccatcatgaagagcaaaaagatcttgcttttggcatttggcgaaaataaggccgatgcggttcaaaagatgatcgaaggccctgttaccaacgacgtgccagcatctattttgcaaaagcatccagatgttgtcgttatcttggacaaggctgccgcaagtaagttaagccacaaataatcagccattcagcaccatttaatggcgtgagcggccacattagtttgcgcaggtgaacattaaaaattcgaccctggagaattttatctggggtcgaattttgtttctgcttcattataggaagttgctgatc

SEQ ID NO: 31 - DNA, 196 bp, Lactobacilllus rhamnosus
caaccgatgtggcggcaaccagtgaagccgatgttgtgtttcataatggtttgaaccttgaaaccggtggtaatggctggttcaagaagttggttaagacgtcacacaaagaatttgataaggatgttttcgctgcaagtaaaggcgtgaccgcccaacacttaacaacgaacaccaaggaacaggatccactagt

SEQ ID NO: 32 - DNA, 1449 bp, Lactobacilllus rhamnosus
agataacatgacgactttgatttttggacatcaaaaccctgatacagacgcgattacaagcgccatgagttgggctgaatttcagaagcaagcaggtaataccgatgttgaagcagtagcactcggtgaaccaaacgatgaaaccaagtttgtattggatcattttaaggttgctgcgccgcgggtcattaagacagccgcaaatgaaaccgggcacgtaatgttggttgatcataacgaattccagcaaagcgttgctgatatcgaagacgtgcaaatcgattcagtggttgatcaccaccgcattgccaacttccatacggcgtcaccactatattaccgggcagaaccagtgggcagtaccaacacggtgattttcgagttgttccaggaacacggctatgaaatttcaccaacactggcaggcttaatggcttctggcttgatttcggataccctgcttctgaagtcaccgactgcaaccgacaaggacaaaaagatcttgccggaaatggctaaaatcgctggcattgacctgcaatcatacggtttggctatgttgaaggcgggcaccaatctagctgccaagtcggatatggatatcattgaaggcgatgcgaagagctttacgatgggcggtaagtctatccgtattggacaagtgaatacagttgatcttgatgatatttatgcgcgtcaggatgaattggtggccgctatgaccaaagaagcacaggcgaagggctatgatgacttcctgttaattgcaaccgatattctgaacagcaattcagcgggctttgctgttggcgcagatcgtgacaaagtggccgcagcattcaacgaaaagtttgatgccaatgaccggttggcactgcctggcgtggtttcacgtaagaagcaggtcgtaccgccaatgcaaggtgcgtttgaaggttaattttgaacttaataattggttttataaatcgcagccgtttgtggttgcgatttttttgtgctcaaaaacttggaagaacaaaaaagtcgaatttttagatctgaaggtgcagaaatgtgattattgcgaaatttttcagtaagaatagttcaaatttaaaacgaggtgcaaaaaacgcagccttataactacttcgtataatatatattatgtaaactagaatggagattttgagtcgttgactttgacgtgacttatttggtgttcaaatggcaaaacgattgatgcaagtcccctcacctgacagacagctcaaaaacttttgagagaagcaaatcaattgtacggatgtgagcggtgcgctttatttgtttttttctggtttgaaaatgaccagtcgttgctaaatatatgtaaattcagcattaatcaaagcagatttgtagaaagtatcattttgagtcataaacagcattcaagtcgcaagtgttgctgtcagctgaattctg

SEQ ID NO: 33 - DNA, 1349 bp, Lactobacilllus rhamnosus
ccataaacgatgataatttcccaaccaacttaatgaacgttcaatgagccaccgttgggggataaccgaaaattggtgtaactcatttctttaacgacgattaccttggctgaggttaaactgctaatctcattggcaaaattttggccggtataaccactatcaaccatcatggttcgaaccaatttaaactgctctaaattaagggtgacgagtgcaatcgccccgtcacgatcagtgatgttagcccgggtaatatggatagcttgggggaatccattgatgtcaacggctaaatggcgcttaatgccggaaattttcttgccaccatcgtaacccttattttcagcggtagcggtgttcttaatgctttgggcatctaaaatgacgaacgaagttcgggctgaccgcccttgccttaatcgtcgatcagcgacaatttttttaaaacctgagttaataaagctggtttatcaggggtgggggcttttgaccaactcatccaatagtagtaaacggtggaccactttggataatcagccggcaaatcacgccaagtacagccatttttaaggacatagagcatggcacagaagatatcataaggatcaatgtgttttgggtgagttcgttttcttgaagcttccagatcctgacggatcaaatccaattgttgccgagaaatatcgctttggtaatgatgactaaaatgttgcatatgatcaccaacttttttgacagtagtttatcaaattattgggtcaaaatcaaagatactaaacagcttcttaagagattttagacagcttctaagggatatcaattagcagatacggtaatcgtaacttctacaaattttgattaaaaaggggccgttattaaaattatcgataagattgagaaaacctcagtttcagggacgaagacttggagggataacaacaatcaagatggaatccgtccaagttcaatcacggtaaactcattggccaatggtcaacaagttgcaagcaagaaagttactgccagtgataactggcagtacagtttcgacaacttagctgcttatgctaatggtcagaagattacctacacagttacggaagatgcagttgcggggtacaccagtactgttgatggttacaatattactaatacccataatccgacaacgcctaagaagccccaggttcctaataacccgacaacgcctaaggaacctcaagttcctaataatgggaataaggtaacaccaaaggatttcactcaaggtaaaatgtacgataaaacaagtagattacctcaaacaggtgatggatcatcaatgggtatgatgttaattggactag

SEQ ID NO: 34 - DNA, 412 bp, Lactobacilllus rhamnosus
atcggctttggtatgggtgcgataatccatttaaggtgtttttgccttcaacctggatccatttctttaacttcttacgttaggagtggacatgaaacaaatcctgacttggctggtgcggggctaccagcgatttatttccccgttatttccgccgagttgtcggtattatccgacttgttcgacgtatatgattcaggcattgcaacgacatggggcggtaaaaggatttttaatggggattgctcggattttacgatgcaacccctttgttaaaggtgggctagatccggtgccagcttattttacgttgcggcgtaatccgcatcccgaaaatgatttggatcttagtgacattcaaaatcttaatcgcaagctaggaggccatcatggctaaagaaaaaaatattaa

SEQ ID NO: 35 - DNA, 1836 bp, Lactobacilllus rhamnosus
gatcaaccttatcagcatacaggccaccctttgagcgataatccggaatccccgaagccgttgacacccctgctccggtcataaacgtcacatacttagccggagtcactgccgtctgtaaatcaaacattagccatccctccgtcgttatctcttcctatcaccaatatagcaagcatcccaaccagtattatttaattgccgtcaacgtttccccttgacaagtcgtttcaagtccatgacagcgcattcagccgtcaaaaataattttgtatttcttaacattctacggtcgaaaggtgtaatattattctatataaagattgatagaaaggagtcttgattgtcatgaaatcctttcggtggtcgcacttctttagttatttgattatggccattgttttagttttctttgccattgttctttaccaggtagtcatgcttggtattcaatccgtcactaacggcttctttattaatttcggtcatcattaacggattgtataatccagttggtactgcgccagaacgtcattcagcggttgttgatacagctgctggaaggcttctggcgttgttgcgttctcggacagcggcaagacgaatgcattttggtcatcacttcgacccatggcaacataagcaggctgcttagtctcccgatcgcggtagccactgtgcttgattaggtaaacctgatccaaggtgagtcgcaattgccgtttggataaaaccggtgacaacgtagcgaattcctgatcacactgcagttaaggcgccttatgtccggttaattaccaccgaaaaaggcccgaatggcgatgaaatttctaactatgatttacgcttggttcagccaaacaccgctgcgattgatactgccgggttgcatacaattgaacacttgttggcatcgttattgcgcgatcgcatggatggcgtgattgattgttcaccgtttggctgccgcaccggctttcactttgattacctggggaacacacagcaccacggaagtcgccaaagcgctgaagtccagccttgaagcgattgctaacgatattacctgggatgatgtacccggtgttgacatcaagagttgtggcaactacaaagatcacagcctgttttctgctaaagagtgggcaaagttgattttgagtcgcggcatttctaacgatccatttacccggcaggttgtctaatctgacgagcattgattagaaccaaaaatggcactgcacaagttcgaatagcgaacctggcagcgccattttcatgtcaccatgtttaactgaatagatcaatcaaccaccggccaccatatagcaaactcatgctataggcgaagatggtaatgggtttgccgagtataataatccagaagaacctggtaaaggtcattttggtgagaccggcgagcaaacatagcacatcatctggggcaaccggcaacacaatagcaagggtaaacaggtgatcaaagcgggtctgattcttagtgtagccgatgtatttttcataagttttttccgaaattaaatacggtcagcaggggcttgccaaaacggcgggcaagaaaaaagttaataaaagatccgatcgcgatgccgatgtagttgtagagaaaaccaaaccacgggccaaaaagaatcacacccgcagcggtactgatgccgcctggaatgatgggaatcacgacctggatgacttggatgacaacgaaaaataaagctccggttaagccgagtcgggcaatgtaactttgtaaaaccttgacatcagaaagaatccctagatcgcaccaataaatagtgacgacgactaaagcgatcc

SEQ ID NO: 36 - DNA, 1412 bp, Lactobacilllus rhamnosus
catatggagcggatgcggttaagttaaaggtgacattgccggttttagtatcgactttaccggagaagactttaccactcatggcatcggtcgcgtatacgatcagcaggtgccggttggcgttgccatggtggtggcggtcaatgcgaccacggtagagttgaagaatctcgcggtcacgcctgcccgccgccgtcaagggattgcatcaggattattgcggcatgtcagtttggtgtacgccgagaaatatcaggatatgctggtgggtaccggagatgctgattttgataatcttaggttttatatgcgccgcgggtttcgatttgattcgattcggaagcatttttttgatgaatatagtcagccggtttatgctgatggcttgcgattacaggacatgatcgtgttacgccgcaaattgttgttgacgcgtgaggataagacaaaggagtaaggctattggcgaaaaagcgccgacgttttaccttaaagaaggttccattggcggcttggctggtcatcgctttttttgcggttggttcaatgttggttgtcagctcgtattggtcgcaacggcaagccgaagtttcacaacgccaagcaattgtcgataagaaggcggctgaaaaagcgaagaaagaggcttttatcaagcgattggtaccgacagcccaggccatgcagaaacagtatggcgtcttgacgagcattacgctggcccaggcgattcttgagtctgattggggaacaagcacgttagccaaggattaccataacttatttggcattaaggggacggatcctgccaccacgaaagtattacggacgaaggaatacgttaatgacaaatggatcacggttgacggccggtttcgggtttatagcgatgatgctgcttcgattcgggatcatgccttgctattcgttaacggtaccgactggaatccgcagcagtatgcaacggtgcgggccgcaaaagattataagactgccgcctcggctttgcagacggatgggtatgctactgatccggattatccccagaagctgattcatttgatcgaagcatggaatctgacccagtatgacaattgaatgttcgtattttgttgattattgaatcctcgttatttggttatggtagcgccaaattgcgggggtttcgttcttttatcgctgtgaaagcggctacttagtttgttcgggaattagtgagcttgtattgttccacggcgttttttatggtaagctgattgaaaatttacaaataaaaggagtgcttgtggtgaaattactggaagaccggattaaaaaagatggccaagttattggaacagacgtattgaaggtggacaactttttgaatcatcaagttgatcctgatttaatggctgatcttggtaaggaat

SEQ ID NO: 37 - DNA, 1914 bp, Lactobacilllus rhamnosus
gctgcacttgaatttgtacatacctattctttgattcatgacgatttgcctgctatggataatgatgatctccgccgcggtcagccgacgaatcacaaacagtttggcgaggcgctcgcgattttggctggggatgcattgttaaccgacgcattcgctatcttaagccagcactatccgggaaaaggtgccgaactcgttcaaattctggcagaagcggctggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagctgccttagccgattttgcggctgcttttggtctgggttttcaaatcaaagatgatatcaatgatgtgactaaaaccaccgcggaattaggtaagactgccgataaggatgtggccgaacacaaaaatacatttcccgaactgctgggattagccggtgccaaacaagcattggcgacccagtttcagctagccactgctgcgttaaacagcctgaccgttgatgcagccgacttaaaatcgattttggcggtgttacaagcatgacaaaggtaaaaaaagaacgggtcgatgtactgcttgtggagcaaggcttatttgagtcacgcgaacaggccaagcgttcggtgatggctggcgaagtctatgatcagaacaatcaacgtttggataagccgggggtcaaaatccccggcgatgccattttgcatgtgaaaggcaaaaaaatgccgtatgtaagtcgtggtgggcttaaattggctaaagcactgaaagtatttgcgattgatttgacgggtaaaaccgtgcttgacattggcgcatcaactggcggtttcaccgatgtggccttacaaaatggtgccaaaatgagctatgccttggatgtcggctataatcaactggcttggaaacttcgtgaggatccgcgcgtgaaagtgatggaacgggtgaattttcgttatagcaagcctgaagattttaccgatggccccgtggaatttgccatgacggatgttagttttatttcgttgaaactcattttgccgccgctaaaagccatcttaatgccgcacggtcacgcggtggcactcattaagccgcaatttgaagccgggcctgcgcatgttggtaagcatggcattgtccgcgatccccaggttcatcgggatgtgttgaagatgatcgttaactttgccagcgccaccggctataacgttttaggtttggcgtatagcccgatcaaaggcggcgaaggcaatattgaatttttaattcatttgcaaaatgctgaccaaacccctggagaaatcgcaccaactgttgatatcgagcgaacccttagtgatgcgtatgctgcattaaaacgcccttaattgaatatttatgcaaaaatttggtaagcctggtgcgtctgcgctatgctatgggtaaagcatttttccacgttaaaaatgcattcatgacagaggtgagcacatgcgaaagcgcgaacgacaagcgacaattcaacggttaattcaaagtgagccgatagaacggcaggaagatttggtggcccgtttgaccgagatgaaaattccggtcactcaggcaacgatttcccgggatattaaggaaatgcaactggtcaagattccggcaggtgagggacactatcgctacagtatgcccgcggaaaagcagctgcccgctacggataaactgcggcggacattggttaccgcgatgaagtggggcgaagcaatggataattttgtccatttggcgcttttgccagggacggcagccgcggttgagacgttgatc

SEQ ID NO: 38 - DNA, 1469 bp, Lactobacilllus rhamnosus
acctttgccggtttctttgcctcggcttcagcggcgacgacattagccgataaggtcgctccgatttttgggtcctggtcgtttgcacacgaagcagcagtgattttagtgacgttgattttgtcgtatttctcgcttgttttcggggaactttatcctaagcaggtggcgcttcagatgacggaacgggttgccaagatcagcgtcaccccgattagttggctggcaacgttaatgcgcccgtttgtctggctattatccgcctcgactaaattgctgatgaagctgacccccatggagtttagtcatgaaggcgagtccgttacccgtgaagagatggttgctatgattgaaaatgggcgcaatgccggcgcaattgaaccggacgagtaccaaatgtttgaaggcatcatctctttgtctgatacgatggcacgtgaagtcatggtgccgcgtacggatgcgttcatgatcgatgccaaggaaccggatcaaagcgctattgatgcaattttgaataacatttattcgcgaattccagtttatgaagaagacaaagatcacgttattgggatcgttcatattaaaaatctgctcaaagaagcccggcgtgttggctttgagcaggttaagatcgaatcggtgatgaccgagccggtgtttgttccggagacgatccccgttgacgtgttgttgactgaaatgcaaaccaagcaacaacagatggccattcttttggatgagtatggcggggtcgttggcattgtcacgattgaagacttgttggaagaaattgtcggcgatattgatgatgaatccgaccaggctgagaagctatacacgaaacaaactgaccacgacttcattgtttcgggacggatgccgatttcggaatttaatgagctgtttaaaactaacttagatgcaccggatgttgacacgattgccggttatgtgctcactcaacttggggccattccttcgacccatcatagtgagaggcttgagctggctccaggggtgcagcttgccactggtaaagtcgaaggttctcggctggtcaatgtgcatattcatttaagtgagacgccacctttagaagttgtttccaaggaggcggatagttagcgatgccagcattgagagttaaaggtatgttggcagtcgtagtgttatttttggaaggaaacagattatgaaaccacaagaacgagcacaagaagtagcaaaacggcgaacgtttgcgattatctcacatccggatgccgggaaaaccaccattacggaacaactgttgttatttggcggcgtcatccgccaagccggtaccgttaaaggacggaaatccggtcattttgccaaatctgactggatggaaattgaaaagaaacgtgggatttccgtcaccagttccgtcatgcaatttaattatcaaggtaagcgcatcgatattttggatacgccggggc

SEQ ID NO: 39 - DNA, 681 bp, Lactobacilllus rhamnosus
tttatccgaccttggttttaggtggcaccttgaaggctttaccaaaagaagtcaccgataactttaaagaattatttgcgacgttgccaaaattgggcttgaacgaatgggtatcaaccccttcttttgtcgaaattgcgttacttgatcgagttcctgatttaagcgatgctgtggttgcaagcctgccatcttccccacccattacaaatgttcatcaggaggtaaacaatgcgcgtgtcaaaatcaagtcattatgaatttaacaatgaaatgtttagcgccatcacccatgcgtttgcacttggcttagccgtaaccggcaccattgcgttaggcattaaaggcgtcaatagcggcagtcaagtcgaacttttcagtcttatcggttttggcgtttcgctcatgttgctttacaccgcctcgactgcttttcatggtttttattttagcaaggcgcgccatgttttgcaggtactcgatcactcaggcgtcttcattctgattgccggctcctacctgccatattgtttggtcgctattggcgggaaacttggcatcggtctattaatcgccatctgggcattgtgtctcggcggcattgcctacaaacttttcttcctgaatcgcttcaagcatctggaaacgatgatctacgtggtcctcggctggctttgctta

SEQ ID NO: 40 - DNA, 3279 bp, Lactobacilllus rhamnosus
attcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaaggtaaacagtcaaaaagccctaaaccccccaagaaattatggcggcggattttaaaatggaccttgctcggcttgcttctcattttcattgccggtgtcgggttattctcctggtatgcaaaagatgcacctgaagtcacccaagcaaaactcgaatctggcggatccagtacgatttatgatcgtagcggtaatgagattacaacgcttggactggaaaatcgcgactatgtcaaagcttccgagattccgcaacaacttaaagatgcggttgtttcaattgaggaccgccgcttttacgatgagaaattgggcattgatcctgtccgtattctcggtgctgcttttaacaacatgaccggaaccggtgatggcttgcagggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatttgagtcttgcacaaacggctttcattgccggcctgccgcaaagtccggctggctacgacccttatgagtacccgcaaaaagcgactcagcggcgtaatgcagtcattgatgccatgttacgcgataagaaaattacggccgctgccgccaagcaagctaaagccacaccgattactgatggtttacagccaaaacaacaacagacaaacacaaccaccaatgataaagtgattgattcttacttgacgcaggtgattgcagaagttaagaagaaaaccggtttgaatccttacacggacaatctggatatttacaccaatattgacatgagtgcccaaaaacggctctacgatatcgtcaataccgatgattatgtcagtttcccggatgatgccttccagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgaacagtcccgcaacattccagccgtcaaaaccttgagtgcagttggtatgacgaatgccgtgaagttcttaaagggactgggtatcgacttacctgcctcagaacaatatctttccagtgcgatcggggcatcggtcaacacggttgaagaagccggagcgtatggagcctttgctaatggcggcacttattacaagccttattacgtcaataaagtcgttagcgccgatggcaacacccaaacatttaacagtcaaggaacccgggcaatgaagtccagtaccgcctatatgatcacggatatgctaaaaggcgtgttgacaaaagggacaggaacctcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccatttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcaaacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcgggtt

SEQ ID NO: 41 - DNA, 1152 bp, Lactobacilllus rhamnosus
aacaaaaatggcgataagcctgattatgtcaccaacaaagctaaaacggccaaaatactgagtcgttatttggcgattggtgaagataaagttttagcacgtttaaatccaagtaagaatcttttccaagtcgagtttggtcggccagggacgaaattaagtttggcgatcaaaaaacaaatcgaagctgagaaattgccggggattcattttcgcgaaaccccatcgcggctttatcctaatggtgtgtttgccagtcatgtgattgggttggcacaagcgcaggataatggcggcggtttgaccggggtgatggggttagagaaacaatttaacaccgttttaaccggcaccaatggctatcggcgaagtgaaacagatgcatatggatataaactgcctaatgccaagaccaaagccaaggccccagtgaatggcggcagtgtctatacaacgcttgatagtggcctccaagcttatttggaaactcttatgacagatgttcaaaccaaatatgagcctaaaggcatgacggcggttttgatgaatgccaagaccggacgtattttagctgccacacagcgtccgacgtttgatgcttcgactggcgaaggattaggcgatatgtggcgggattctttggttgaggataattatgagccgggatcggtaatgaagatcatgaccttggctgctgctattcaaagcggtaagtatcaccccaatgaatatttccagtccggatcggttaagcttgatggcggcacggttaacgattggcggacaggcggctggggatccattccgctgagcaaagcgtttccgttatcgagtaatgtcggcatggttaagatcgaacaggaaatgggtgccggcatttggaagagttatttggataaatttaaatttggccaaaaaaccggcattacgttaccgggagaaacaagtggccggattagttttcaacgcccattggatcaggctatcaccgcctttggtcaaggcattgaagtcaatgtgatgcaaatgatgcaggcaatcagtgcggtggcaaatgatggcaagatgcttaagccgcagattgtatccaaggtggttaacaagaacggtaaagccactgtttataagccggaagtggtgggtcagccgatc

SEQ ID NO: 42 - DNA, 2726 bp, Lactobacilllus rhamnosus; identical to SEQ ID NO: 30

SEQ ID NO: 43 - DNA, 448 bp, Lactobacilllus rhamnosus
ggtatgggaagtcagacgggggggtcaactttaacgcagcaagtggtcaaaatgatgtttttaaattcggagacaacctttaaacgtaaggctgctgaaattatgctggcccggcgcttgaacaatcacttcagtaaaaacaccattctggcaacttatctcaatgttgctacgcttggtcgtaataacaaaggccaaaatattgccggagttgaagcagcggctcaaggactgtttggggtttcggctaaggaagttaacctgccggaagcggctttcatcgctggcctgccgcaaagtccatttgtctataccccttacacggccgatggtaaattgaaaaccagtctcaaagccggtatcaatcgccaacaaaccgtcctgttccgcatgtatcgggctggcgttatcagccatcgtcaatatgttgctgccaaatcatttgatc

SEQ ID NO: 44 - DNA, 479 bp, Lactobacilllus rhamnosus
ctgccgatgctcaacaaacgattgatgctaacaaagaaaagctggcagccatggccgctgatgaagctgcaaagctgaggcggctcaaaaagcagttacagctgttgctagttccaccgctagtgcatcaagcacttctgcttcctctagcacaaccgcttcttcaaatagtctcggctctagtaaagctgcatcttctcaggctcccgcttcagctggaagcagcacagtttccgtgtccggtggcagcatcgccggtaacgccgctaaatacctcggcgtaccgtatgtttatggtggcacatcacctgctgggtttgactgctcaggcttaatctattacgcagctaaagaagccggaattagcctgccacgtacctctcaggcgcaaagcacacttggctcatatgtttcggtttccgatctgagttttctaatgcgcagattttcagaagttattcggcgttaatcccttgatc

SEQ ID NO: 45 - DNA, 2473 bp, Lactobacilllus rhamnosus
gatcattttcttcatcttgccgattggactggcttatcttagcaatttgctatttaccaaaacactgcactatcaggtatcggaagactatgccttgcattacgactaatgggaggtcgaaaagcattcacgcaatatacgtgatttttgaagctttagtcggtggcaaacaaagagtagcttcttcatgccaccgaaactacatagagacgggttgttggcttcgcagttaatatgcaaagcaacactaaatatttttcttattggtattggcgtataaccgtttacatgataaaatgaggaagattttagtccctttgaaagcgaggcgagtgtcgtgttggcatggtgggcacagcaagaactgtggttacaggtgatcgtcggggtggtggcgctattgatcattggcggtctcttatggatgttgtatcgctggtgctgttacccgtatttagcgtattgcaacggctactgtcgccggttgagaacaccacatcaatgagcgatcgggattacttactcggtacgctgacgttagatgtggcgcatcattacactggcgaagtcatggtaaccggtggtggtcgggcccgccagacatatccggccaagctgtggtcggataaaagccagccgctaaatcagggcacaaaagtcgtgatcattgaactcaaacaaggtattgcctatgttgatgccttggctactcacaaccctaaggagggatctgatggaaattttaactgattatatgccgtggattatcgcggccgttttattgatcttgctctttattttcctggccacccatcgtaagaccgctttgcctaacgaagtcttgattatttccggtgctctaatttccggcaagcacagttttcgcgatgtcaatggcaatcgtgtcaagttgattaccaacggcggatcttttattttaccgattttacagcgctgggacgttttaagtctgaatacgcggaccattgaagtcgcaacgcctgaagtctacacgcaacaaggggttccgattattgtcaacgggacggttattttaaaaatcggctccagtcaggaagaagtcgcaaccgctgcggaacaatttttaggcaaaaatgacgagcagattaattcggaagccaccgaaattctggaaggccatttacgggcaattttgggcacattaacggttgaggatacctatcagaatcgtgatgcctttgccgaaaaggtccaggatgtggcgagttccgatttagccaaaatgggtttacagattatttcgttcacgatcaaagatattgccgacaagaacggttatctggactcactgggtaagaagcaaattgcggaagttaaaaagaacgccgctgtagccgaagcagccgccaatcgcgatacccggattcaacaggcgcaagcagatcaggaagcaaagcagcaggaaatcgaacgtcagacccaaattgctgacgccgaacgggaacagcaggtcaagatggctgacttcaaaaagcaacaagaaattgcgcaggcgcaagctgatcaggccgcgattgttgaacagatgaaggccaagcaggttcaaaaagaaaaagatattgaactagcacaaaagaacgccgaattgcaggaacaggaattgaatgcaaccgtgcgtaaacaagcggatgcggacttgtataaagcccagcgtgccgccgaagcccaaaaagcaacccagatcgcggccgctgaagcatcagcaaaagaggttgaattggatgccgaagccaaagcaaatgcaaccaaggcgattggggaagcagaagccggcaagaccaaggcgatcgggcttgctcaagctgaagcgattgctaaacaagcggaagcagcacggcaacttgatgaatctggccgcttcaagatgacgattgaagcaatgccgaagattattgaggctgctatgagtccgtatgcaaatgttgactcgattaagctttatggcgatggcgacctgacgaatcaaaccagcggcagtttggtcaagcaactggacatgctgcaagaagttgccggcatcgatattcgcgggatgttaaatggcgcactgatgcatcaggctggcaatcaaccggttgtcgatgcgatcaagcaccacgagcaaccagcagccaaagcgcctgacaccaagcaaccagcaccggcgccaaagagtgatcaaccggccactaccgagcaagcggcatcaagtacaccatcgcgcatggccgagaagcaaaagtagtcatgagtgaaattcagaatgattgatcagttgtcatggcactgggtgttctttgtgaatgtgccgctgggaattctggtctttggcttaattcaaattggctatcgggaaccgcggcgggaacatgtgtcgcttacgattgattggctcggaatcgcttggttagctgtcactttggttgccttgcttttaggcattcaagcactt

SEQ ID NO: 46 - DNA, 1601 bp, Lactobacilllus rhamnosus
acagtcaagacactttcaagtacaaccaatttaaagtgctggattatatgaccaaggaaggcctgacttttaaggcattgacggcaatcacggttgacggtcaggacattttaaaggcgctaaccagaaaaatggtcttcatgacttccaatgacgcagcttggcaacacacacacaactatccattcgggtttgaactggactttctaggcggggtcgatcccgatgcggtacgaaacctgttgacccaatatgccggcaaacgcgtgaccgttgcctacaccggaatcgtcaatgagaaaatggtcccagaccaaaaagtcggtaacacggctgaagtgagctttgatcctgacagtaagattaccgtcaatggcccggaaatccagactggcgggattcgattcttcaaacatgaagccggatcttccaagagtttggccaacgcgacttttatcttacagcgaatgaacgccaatgtgcgcgaatatgcagttcttgaaggcgttaatggtatgcccggaacctaccaaccgaccaagattacctggacaacgaatcaagacgcggcaacaaaactcaaaaccagtggagccgagacagccaacttaaccattcaagggttgttgccagggcgatataccttggttgaaaccgcggcaccagaaggctatgaaattctcgatccgacaaacagattttgaagcccattgccggtacttggggtacgaaaacgattcgcatcgccaacacgccggtgaatcaattattgccaatgacaggcggaatcggactcttcgccttcctgatgatcggggccatcttaatgggtggcggtcacctcatgaagaaaaagaccagcaagaaagtctaatggcctatgacaaaaaaagcgtcggggacaagccggcttttacgctggttcgtcatcctactttttactgcgggagccgcgtgtttctgctatccgttcgcggcaacggcgattaatgaattgttactgaccagtcgccgagcagcagcgcagcaagaagccaagcaaaatgccgccgcccaagatgagcaacgggcagcggagaaccgcgcacttgcccagactggtttgcgcccgggacaggatccgtttcaaagcaggcaaaagtttaaccaagcctatgtgaaacggcatctgatcgggcgagtggttatcccgaaattagcggttgatctgcccctttttgacaccaccaacaacacgctgttagatcaaggggcagtggtgttaccaggcaccagctatccacggggaggcaaaagtacgcatacggtcatttcagcacacggcggcttacccaccaaacgctttttcaccgacctgagcaagttgaaacgagggcagaagttctttctccaagtcaacggcaaaaagatggcgtatcaggtctttcggatcaaaaccgtgcggccggatgaaacccagagcctacgcattgaaccgggacgcgacttggccacgttaatgacctgtaccccgtatatgatcaactcccaccgcttgctagtgaccggcaaacgggtaccttataccgaagcgcttgagcacgccgctgaatctgctgatc

SEQ ID NO: 47 - DNA, 1681 bp, Lactobacilllus rhamnosus
aaagacacatcccttgctgcctcgatcaccattgtcgaaatgtttcaagtcagccaacaaatcgcggcggaaaattaccaaccattactgatgtactcaatcgttgcgcttctgtatgccattgtctgcactttcttagcttggggtcagcggtatctcgaaaaattcacatcacgctacaatgccaatgcacaaaccacgcaattataatccgccattttgaaaggaagaaagctatgttaaagaaaaagttgtggttcctgttgccgcttgtggccttggtaaccttcacgctcaccgcttgcaccagcgcatcatctgacacgtcaaaaaacagcgacgtcaccgccgaactcatcaacaaaaatgagcttaccatcggccttgaaggtacttatgcgccattttcttatcgcaaagatggcaaacttgaaggcttcgaagtggaactggggaaagccttagccaagaaaatcggggttaaggcaaaattcgtgcccacccaatgggattcgctgattgcaggattaggcagccagaaatttgatctcgtactgaatgatattagtgaaacgcccgcacgcaaaaaggtctacaacttcaccactccgtacatgtactcgcgttatgccttaataacccgcagcgataacaccaccatcaaatcgcttgccgatattaaaggcaaaacatttgtcgaaggcaccggtacacccaatgccgctttagccaaaaaatacggcgctaagatcaccccgtctggcgactttaccgtatcgcttagccttgtgaaagaaaaacgcgcagacggaaccatcaacgcctcggctgcatggtatgcctttgccaagaataactcaaccgcgggcttaaagagtcaaaccctcaaagatagtgtcgttaaacccgatgaagtagctggcatggtcagcaaaaaatcgcctaaactacaagccgcactttcaaagggcattcaagaactacgcaaagacggcacgttgaaaaaactgtcgcaaaaatattttggcaccgatttaaccaccaagtaatcatgccattcagctagcaaacattgcccgtcaacctgcttcattgacgggcatacataaaagaacactattcattaaaggaggtcgggtttcaatgacccaattcaataccaaactcgttcatggaccacaactaaatgtcgaccaagccggtgccatcgtgccaccagtataccaaagtgccatgttccgctttgctcctgatggtcaggaaacccactgggactatgcgcgcagtggtaacccgacccgtgaatacctggaacgtcagattgctacgctagaaaatggcgatgctggctttgcgttttccagcggtgttgcagcgattgcaacggtgctcgcgattttccccgaccacagtcacttcattattggtgattcgctctacagtggcaccgatcgcctcatcaaccagtatttttctcaacacggcctgacctttacaccggtggatacgcgtgatctggcagcggtggaagccgccatccgccccgaaactaaagcaattttctttgagactttttccaatccgctcctcaaagtcagcagcgtcaaggccatcagtgccctcgccaaaacccatgatctgttaacagactgtcgacgaacacgttgcttaacccgaaggg

SEQ ID NO: 48 - DNA, 754 bp, Lactobacilllus rhamnosus
tatggtctaataagtccactttttttaaaaatatgtgttatttagccctaatccttcaatccggagtcaggtagcgttgatgttatgaccaaggcagatagggggttaagggatgcggttacaggaaaaggtcgccaaaagaatccacgaattaagactcagcaaatccatgacccaggaacaactagccgaaaaagccaacatggacgtttccatgctagccagaatcgaacgcggaagccgcggcgacatcagaatgagcacactagaacgcatcgtttccggattagacgtcagttatcaagaattcttcacttttccagaagacggagatgaaacaaccgaactggcttcttcaatcgctttgattaaagatccggaagttatccgggcactccacaagatcgtgaacacgttgattcatagggacaataagtgataaccatgcgtaaacgactgatcatgaatttatttaatccaacatcttttcttatatttttgatttcaaaatggcaattttaaattcttcctcttgtttttaacgtattcaatcaagtctcatcaaaaaagccgccagttttgtgcaaatgcacgcgactggaggtttttatgtgcgataactaaaagagtgaaagttgaatgtccggagaaagtcccgagaagacgggacttttggtgttaggcacaatgccgtctggtgttaggttaggcacaactttattcaggatgcaaaatatggtagactaaaattacc

SEQ ID NO: 49 - DNA, 1535 bp, Lactobacilllus rhamnosus
gatcttattggcgctattgtttggcgttggtgccgcaacaaccagtgtgatggccaacacccaatacatgacagtcaaagccgagagcgtcaatgttcggctaggtcccggcttggcatatggcatcatgggtcaggtgaaatccggcaatgaattgaccattatcggttccaaaaattcctggtatcaagtgcgccttgccggcaataaaatcggttgggttgcttcatggttagtcgatcaaagcgaagccgcgaccacgagtgcgaaagttgccacggtgaatcaaccggttaacgttcgcgaatatgccagccaggatgccaagcagttaggaacgctcaatgccggtgatagtgtcaaggttgtgtatcaagaaggcgattggacccagattgcctataataatacggcggcatggatcactagcagcagtgtccagctcactggtcagacaactaatctggcgcaacctgcccaagccaatcttacgcaagccaaaagcggagccgcattgaaagttaccaccaataccataactaacttgcgcaatgcggcgggtatcaatgctccatccgtcgaaaagctcgataaaggcactgaattgaccgtcaccaaacaacaagacgattggtatcaagtcactgcccctgatggcaaatcgggttatgttgccagctggaccgtcaccgccccgaataatggtcaaacccaaaaagcggcaacgaaactatccgaagccacgattgttctggatcccggacatggtggtacagacacgggtgcgccggctaacaataatcatgattacgaaaaaacttataccctgaaaacggccgaactcgttgccaatgctttgcgggctgccggtgctaacgttatcatgacgcggacaactgacacctttgtcgaccttgcgccacgtccgacaaccgctaacaatgcccatgccgacgcgtttatctccttccattttgactccagcccgtccaaaaactcagcctccgggttcaccacttactactacagcagcaaaaaggatctcgccttggctaaggcggttaacaacgcttttgatgacttaccactagaaaatcgtggggttgcatttggtaactatgaagttctgcgcgataataaacagccggcgattctgaatgaaatgggttatatcaataacgacaaagactttaagtatattaaaaacccaacatatcaatctaaaattgcggacggatattgttaacggtttaaatgcttactttaaagccggtcatcatcaataatcggcggaaagtttgccgcggcaaaagcgcaaatcgaatataaagagccgctcaatcaggcatgaaaaattgctgattgagcggctctttatttgaattttttacttgcggaacaacggcggaatttcaattaaatgatcgacttgataatctgcctgtggtgctgcattgaggccgtccacattaaagtagatcgttttaacatcagcgttgataccggcatccacatcaagcgagcgatccactagt

SEQ ID NO: 50 - DNA, 2174 bp, Lactobacilllus rhamnosus
accagttgcgtaaagatctcaagcacaagatgaagactgtgccgatcaagtattatgacacgcatagtaatggcgatattatgtcacgggcgattaacgatatggataacatcgcctcgacactgcaacaaagtctgacgcagatggtgaccagtgcggttatgttcgtgggaaccatttggatgatgcttacgatttcctggaagttaacgctgattgcgctggtaacgattccgctgggcttaattgttgtcgggattgtcgcgccaaaatcgcaacggttctttgccgcccagcaaaaagctttaggtctcttgaataatcaagttgaagaaacttatggcggtcaggtgatcatcaagagctttaatcgtgaagatgatgaagttgaggcatttgaaggccagaaccaggcattttatgatgcagcgtggaaagcgcagtttgtttccgggatcatcatgccgcttatgattttcctaaacaacattggttacgtgtttgttgcgattatgggtggcattgaagtttccaatggcacgatcacccttgggaatgttcaggcgttcctccagtatatgcagcaattttcccagccgatttcccagcttgctaacctagccaatacgattcaatccactattgccagtgccgagcggatctttgcggtgttggacgaagaagatatgcaggatgagccgtctggtgtgccggcagtggccaatgatcctaacaaactggtcatggatcatgttcagtttggttataccccggatgccttgttgctcaaggactataacctgcaagtcaaaccgggtgagatggtcgcgattgtcgggccgaccggtgcagggaaaacaacgatcatcaacctgctagagcgtttttatgatattagcggcggatcgattcgcttgaatggtaccgatacccgcgatatgaagcgagaagatgttcgcgcgcattttgcgatggtgcttcaggatacttggctgtttaccggcacgatttgggataacttgaaatatggccgcgaagacgcaactgacgacgaagtattggccgcagccaaagcagcccatgttgacaactttgtgcggcagttgccggatggctacaacacgattctgaacgaagaagcctcgaatatttcgcaaggtcagcgacagttgttgacgatcgctcgggccttcgtggcagatccggaaattcttattctggacgaggccaccagctcggttgatacgcggacggaaattcatattcaacacgccatgaaccgtttgctgaccgatcgtacgagcttcgtagtcgcccaccggctgtcaacgattcgtgatgccgacaagattatcgtgatgaatcacggctccattgttgaaaccgggaatcatgacgaactaatggctaaaaacggcttttatgctgatctgtacaacagtcagttcagtggcaatgtcgcgatttaattcagtttgcaatgatgctgagacctagacaaatattgcgttgcagggaaaatgtttttatcctgtgacatgaaaaagggtcctgaagacaagaacgatcttgccttcgggacccttttagcgttaccgtcgcttatggcgcataaacgttgcgtagtgtagcaaacaagcaagtaagacgaaaaagaggacaacaaagctgacatagcgccaccagaagttggttgccacgcctggtaggagttgctggatgcccatggttgccaaagccattaccgcgatcatgccgaacaacaataagtaacgtttcaaagtctcatcatccttctttttaaaagtggccaattttaccccgagcgcttgagcctgtttgaccttggccgctggtaaagccgtcatgccccaagtatgcgggagaaccagttccgtaattttatgtaaaccggcggcggtcatggctttgtcgatggtgacaagggtcgcatcggtctggtgcgtaaaagtgttgtccaggccggtggcaaaacaactggtgacgctaacgtaatgtttatctttaaactttcccgggagtgtatcgccgtgatgcgtcatccgagtgatgcgatggcgtaaacaatcgagtaactgcttaaactgtccagccacggttccaaagtaggtgggtgttccaagaatccacacatcagccgcttgcaacttttc

SEQ ID NO: 51 - DNA, 1337 bp, Lactobacilllus rhamnosus
aagcttaatggtgctgcaggttctgtactgaacatcaatggcgggaatttgaccctgactgatgatggcgtatctgccggtactctgactggaggtggcttcctgaatatcagcggcggcgtcctcgatattacaggaggcaaccacacttttgctgtcagcaccataatagcaaaagatgcaactgtccgaatgaacgatgtttccggactgggtactggtaacatcagtaacgctgggacattatctcttactcatgcctcaggcttgctaagtaataatctgagtggttctggtacagtatctttgatcaatagtgatacccagatttcaggaaataacagtaactactcagggctgtttgtagtagataccagctctcagttgactgccactggagcgcagaatcttgggattgcttccgtgagtaaccgtggaatcttgcagctgaacaacacaacagactggcaacttataaataatgttactggaaccggtaatgtccgtaaaaccggttccggttcactgactgtccgaagcaatgctgcctggagcggacagacagatattgatgacggctctctgattcttgggcaatctgatgcacctgtcatgctcgccagtagcctggtcaatattgcaaagaacggtaaacttaccggatttggtggcgtagtagggaacgtaaccaatagtggaagccttgacctgcgatcggcggctccgggaaatattctgacgattggaggtaactacaccggtaataatggcacgctgctcattaacacagtgctggatgatagctcttctgcaaccgacaaactggtaattaaaggcgatgcgtccggtaagacccgagtggctgttacgaatgttggtggttcaggcgctaatacgctgaatagtattgaagttattcatgttgatggtaatgcagctaacgctgaatttattcaggccggacgtatagcggccggcgcttatgactacactcttggacgtgggccgggaagcaactatggaaactggtatctgagcagtagtaaaaatactccagaaccaaggcctgatcctgaacccactccggaagggcatgataacaacctgcgcccggaagccagctcctataccgcgaatatagctgcggcaaacaccatgtttgtgacccgccttcatgaacgtctggggcagacgcaatacgtcgatgcaattaccggagaaccgaaagcaaccagtatgtggatgcgccatgaaggaggacataaccgctggcgcgacggttctggtcaactgaaaactcaaagtaatcgttatgtgattcaactgggtggtgatat

SEQ ID NO: 52 - DNA, 1370 bp, Lactobacilllus rhamnosus
ttataattacgggtgtaacttttcaaaacggaggtcatcatgctcgaaaaaaagttttatcataccatgttcagtcactctttcaatattccggtccgtgttgagtattgggaccacacggaagaaacatatggaacaggcgagccgacgatcacgattaaaatgaaaaaagcgatcccagtgcgtttgctgctaaagaatgcttcgcttgcattaggtgaggcctacatgcgtggtgacattgaggtgcttggtggtaagcggccgttgcagcaattaattgcggcggcctatgccaacgcggacagttttatgcgtaacaacaaactcatgcgcgtgttgcctaagcaaagccacaccgagcgcaagtccaagcaggatattcattcacactatgacttgggtaatgacttttacaagctatggctggatccaacgctgacgtattcctgtgcttattttgagaactgggatgacgatctggaaaccgcacaattaaataaaatcgatcacattttacgcaaactgaatccgcagccgggtcggacgttattggatatcggctgtgggtgggggacgcttatgttacgggcggccaagacctaccatttgcatgtggttggtatcaccttaagtaaggaacagtttaagctggtttctgaccggattgaagcggaacacctgaatgacgtggcggaaattctatatatggattaccgcgaattagatcgcgaaccgtttgactacattacctctgtcggtatgtttgaacatgtcggtaaggaaaatctagaagagtactttaaagatgttgccaagttgcttaaagatgacggtgtggccttgattcatgggattacacggcaacaaggcggggccgtgaatgcctggattaataagtacattttcccggatggttatgtgccggggatgacggaaaatctggcccatattgtcgatgccggtatgcaattggacgacttggaaccattacgccgccattatcagcggacgcttgaaatttgggatacgaatttcaataatcaccgtaatccgattcagcaaaagttcggttatgaatttacgcgcatgtgggatgtttacctgcaagccgccgctgcgagttttgaggccggtaacattgatgtcatgcagtatctgattagtaagggtccgtctggtaaggacttgccggccacccgtgactatatgtacgaatagtgccggaaatttagttaacggtttatggacacgacagctttgaaaaggtaccttcaggggtgcttttcttttatggaggagtattcaacttgacgaatatattagtgatcggggcgaccggcaatattggactgccgctgattcaagct

SEQ ID NO: 53 - DNA, 344 bp, Lactobacilllus rhamnosus
caagtacagttacttccgtgctaacgaagactatgcagaaattgcccgctatcttgggctgccaggaaagaccaccgatgaattagtggaaagctatgttcaagccttcattaaattggcacatagcgtcgggatcaagttaagtctgaaggatcagggagttcagaaagcagatctggacaagcaagttgatcgccttgctgaacttgcttatgaagataactgcacggttaccaacccgcaggaaccattgatcagcgatttgaagcacattattctcgatgaatatgaaggaacggattcaacattctaagtacgcacatgctaatcatttcacgatgatc

SEQ ID NO: 54 - DNA, 1511 bp, Lactobacilllus rhamnosus
gatcggttcaacgcgcaatggggtttgcgaatcgtcttcaaatgatgtcatccactcagcccagtttgccttgttagcaactgcagcgcgataccaagcagtttccggtacggcatcagctttttcggtcaatgccttgatgaatttcttggcatcggctaagaccgccagatcggatgtatgttgaaaaatatattgcgtccgccaaacacgttgaggtacaagttctgggcgatgaacatgggcatctattgcacctttttgaacgtgattgttcggttcagcgccggcagcaaaaagttgttgaaattgcccctgctgtggctctgccgttagcattaagaaaccgtatctgtcaaagcgccgttgatttaatggccagtctgcattatgaaaatgccggcactgtcgaatttttggtcgatggcgatcagtattactttattgaagttaatccacgtgtgcaggtggaacataccatcacggaattgattaccggggtcgatattgttcagtcccaattgcgcattgctgccggggccgatttatttgcggacctgcacttaccacagcaagatgcgttacgggaaaatggggcggctattcagtgccgcattacgactgaagatccagaaaataacttcatgcctgacaccggcacgattaatacttatcggtcaccaggcggctttggcatccggcttgatgttggtaatgcctatgcgggtgccgttgtcagtccatattttgattcgttactggttaaggcaagtgtccacgcacctagttttcctgctgcagtggctaagatgcagcgcgcgttacatgagtttcaaattaccggcgtcaagaccaacgtcgcctttttggaacatttactggcaactcagacattccggaccggtgaggcagaaacggcctttattgatgcgcatccggaattattacaagtgcaagcgaaaccagatattgcatcccggttgctttggtatatcagcgatgtaaccgtcaacggctttaaaggcgttgaacgtcaaagccaaaagtactatccggagttgcaatatacacgccattttgctgctgctaaaccgcagacggatttggtggccctacttaaaaatgaaggtgcccaggcggttacggattgggtcaaggctcatccagcgctgcttttaaccgatacgactttccgcgatgcccatcaaagtctgtttgcaacgcgaatgcggacccgcgatatgttaacggtcgccgaggatatgggaaacggcttgcctaatctcttctcaatggaagtttggggcggcgcaacttttgatgtggcttaccgctttttgaatgaagatccgtgggtgcgcttaaagaagttgcgggctgctttaccgcacaccttgttacaaatgctttttcggggtagcaacgcggtcggatatcaaaattatcccgacaatgttattaaggccttcattaaccaggcagcaaatgacggtgtggatgtctttcggatc

SEQ ID NO: 55 - DNA, 1721 bp, Lactobacilllus rhamnosus
ggtgccaatgccgttgtgcttgaaggcgtaaccgtgggcgaaggggctgtcattgctgcgggagccgtcgtcattaatgatgttcctgctcatacagtcgtcgccggggtcccagccaaggtgattaaaaaagtcaacgatcaaaccgaagctaagacagtgctgcttgatgaactcagaaagttgtgacatttaatgaaggaagccgaactcattgctattcgccgccagctccaccaaatcccggaattagcgctgcaggaaaaagaaacccacgccttcctgctcaaaaccatccaaagttttccgcagacttttctcaccatccgcaccttaccgaagttgccaaccgccattctagtcaaagtcactggctccgatccgcaacgcacgatcggttatcgcgccgatatggatgcgttaccggtcaccgaagcaaccggtttgccgttcgcctcgcatcatccggggattgcgcatgcatgtggtcacgatatgcatatgaccgtggcacttggcgttctcagttatttttccattcatcagccaaaggatcatctgattttcttcttccagccggccgaagaaagcaagaatggcggcaaactcgcttgtgacatgggcgctttcaccggtgagtggcagattgatgaattttatggtctgcatgatcggcctgacctgcctgctggtacgattagcacgcggctcggaacgctttttgccggaaccactgagattaacgttgatttaatcggtaaaagcggtcatgcagcgctaccgcaaaatgctaacgatatgatcgtcgcagcggccagtttcatcagccaaatccaaacggttgtcgctcgcaatgtcggccccaccgatagcgccgtgatcacattcggcctcatgcgcgcaggaaccatccgcaacgtgattgccggtagcgcccatctagaaggcaccttgcgcggcttcacgcaaaagcaaattaatttcttgcaacagcgaattcgggatatcggtcaaggcatcgcggccagtttcaactgcgaagtcaaagtcgatttgaatcaaggcggttattatcccgtcgaaaataatccgcacctgacaaaagatttcattgatttcatgcaagccgacccagccgtgacctttgtgccaaccgatccagtcatgaccggtgaggactttggttatctattaaacaaaattcctggcaccatgttttggctaggcgtgaatgatccggattcgcagttgcacgccgctgacttttcaccagatgaagcagctctagcgccaggtgtgacggctatcattcattttctgacgcatcggatggcggaagcggcttgagggtcttgattgatagtgtgcaagggcagtcacggattttttgatgatggcttgccagttggatttaacataatgcgttcgccagcccagaagtctacgtgtaaggaccttaagcgcaatggccaggaccgggccatcacgcttaagccgcttacactccgacttctaaccgcgccggctcgcgctcagggggtttttaaatgcaaagagcagaattaatcaccgcgattgtgacaccgtttaacgaccgcgatgaaattgactatgatagtatgcaacggttagtcgatcatctcattgatcaaggcactgacgggtttgtggttggagctacgacgggtgaagggcctacgttgagtcatgatgaaaagatc

SEQ ID NO: 56 - DNA, 802 bp, Lactobacilllus rhamnosus
ggcaacaactgtcgcatcggccgagaatacagatgtcatcacccaagctgttacgattactgacgccagtgggttaaaactcgggcctgaaaccgtacagctttcaagcaatgactttgttgacagttttgatcagaagaaattctacgttgtcaaagacgcaagcggtaagttaagtacaggtgatgctggcgactatacggcggatgccaaagggaaaattgcgattgtcaaacgtggcagtctgactttcactgacaagcagaaatatgccgaggccgctggtgcagcaggcttaatcattgttaataatgatggcacatccacacctttgacttcgatttctctaacggctacttttcctacttttggtctttccaatacgactggccaaaaactggttgattgggtaactgcgcatccaaatgacagtctgggcgtaaaaattgccttggcattgttgccaaatcaaaattataaagcagatcggatgtcaagtttcacttcatatggccctgtatctgatctttcctttaagcctgatattacagcgccgggtggtaatatttggtcaacgcaaaacaacaatggttatacgaatatgtcggggacctcaatggcatctccatttatcgccggctcccaggcacttctaaaacaagcgctaaataataaagacaatgagttctatgccgattacaagcaacttaaaggcacagcattaaccgattttctcaaaacagttgaaatgaatactgcaaagccgattaatgatattaactatgataatgtcatcgtctct

SEQ ID NO: 57 - DNA, 805 bp, Lactobacilllus rhamnosus
accatgttgacaaaaatgatccggcaactggttcatttgccaaatttgccagtgagtacatgcatccgctttttggctatttaaccgcgtggagtaatatcttccaatttgttgtggtaggcatgtcagagatgattgccattggtgaatacttcaaattttggtggcccgagctgccggcatggctgcctggcctggttgcgatcaccttccttgttttggcaaatctgatttcggtgcgaatgtttggcgaattggaattctggtttgctttgatcaaagtcgtaaccattgtgttgatgatcatcgctggtctcggcgtcattttatttggactaggaaatggcggtcggccagtggggattagtaacttgtggacccacggcggatttttcacaggtggctttacgggcttttgctttgccctgtccattgtgcttggttcttaccaaggcgttgagttactcggcatcacagctggggaagcggaaaacccgcaaccaacaattgttaaagcggtcaaagacaccatcggacgaattctcatcttttacgttggtgcgattttcgtgattgtagccgtttatccttggaatcaacttagcgccttagggtcaccctttgttcaaacctttgccaaaatcggcattacctttgcggcatcactcatcaactttgtggtgatcaccgccgcattatcaggttcaaattccggcatttattctgctagtcgtatgctttacacattggcagatgccaaacagttaccgcgaatcttcacaaaactaaatcgccatggggttcc

SEQ ID NO: 58 - DNA, 890 bp, Lactobacilllus rhamnosus
gatcataatcgggacaaccattgttattccggggattgtgatgcacttcttctgcggtggtatcgcggcaatctttggcaatgctacgggtggtcgcaaaggtgcgctgattggaccgtttatcggtgggattattctaagctttttgcctttggtcgccaccggtctttatggaggcttgggttacactgcaacttattggtctgatagtgatttcaatacaatcggggtcttacttggacttgttgctaaagttggtaagtggccgatcatgctggctgcattgattatctttgccttcccatttgtctttagtgctttacacaagaaaaaactggttgattaatagcaacttttgaattaatagcgctgatatataaaaagtcgatctcatgaagagtggccgcatggcaaacgcgactgcttttcaggatcgactttttatgtactgcatagcgatctgagttttctaatgcgcagattttcagaagttattcggcgttaatcccttgatcagagtccaccatgacgcccttcgtttcatcaaacacgcaaatgttgccatagttttccttaaatcccatgtgattgcccccatcaatgaaataacgcggcgattcatgggggtactgaatgactttaaccggacatttcggatagtttccagttaagggagtttcgggaactggcggtttcgcatcgccggcatagtcaccgtagattaaggcagttggtgtatgtccggtaacaatggttttgttaagcggattgtgcgcaaagatgggatgctgacgcgtttgggtttgctgcatgtcataaatataaggctcccggacccacatgcggttaaacggtgtggtctcttttaaagggttctctaaggatagatc

SEQ ID NO: 59 - DNA, 2278 bp, Lactobacilllus rhamnosus
acttggtttcggttgaagaaatcaaagattaatacattatttcgacaaggaggtgcccaagagtatgcaattgcacgaattaaagccgagtgtcggctcccgtcatgcccgcaagcgtctgggccgtggtacttctagcggtcaaggtaagacagctggtaaagggacaaaaggtcaattggcacgacaaggcggcaagacacgtcttggcttcgaaggtggccagatgccattattccgccggatgccaaagcgcggtttcaacaacattaaccgcaaagaatatgcaatcgttaacctttccgatcttaatcgcttcgataacggtgctgaagttacaccagctgccttgatcgatgccgggattgttaagaacgaaaagaacggtgttaagttgctggcagacggtaaacttgagaaaaaattgaccattaaggttgcaaaagcttcaaccgcagcaaaagctgccgttgaagcagctggcggttcgattgaggtgatctaatgctgaggaccctaaaaaacgcgctcaaggtcaaagacatccgtaacaagatcctcttcactttagcggttttattggtctatcgattaggtacactgattgcagttcccggtgttaatgccaaggcgctgcagtcaatcggctcgacaggcttgatctcactgctggatactgtcagtggtggcggattggcacaatactccatcttttcgatgggggtttcgccgtatattacggcccaaattgtggttcagctgctgcagatggatatcgttccgaaatttgtcgagtggagcaagcaaggggaagtcggtcggcgtaagctgaatcaagttactcgttatctgactatcgcttttgggttctttcaggcaattgggattacggccggctttcaaacgttaagttcgatgggcttggttaaaaatccgtccgttagtacctatatcacaatcggtatcatccttacaggcggcacaatgttgctgacgtggatgggtgaacagatcactgataaaggccttggtaatggggtttcgctgttgatcttctccgggattgtggcacgcctgccttcaggtctccaggagttatatcgggataacgttcaggtatactctggttctgaaatctggaaaggaattgcgtttttagcagctttggcagtcatcgtgatcctggttatcacatttgtcacctgggtgcagcaagctaattacaaaattccaattcagtacactcggcgcgttaccagcgcgggcagtaacagttacctaccgcttaaagttaacgttgccggtgttatcccggttatttttgcgagttcctttattgtgacgccgcaaacaattttaatggcttttcagaagaatcatgggactgacggatggtatcaagtcatgaccaatgtcttcaatatgcaaaagccagccggaactgcgatctatacgcttttgattattctgttcacgttcttctatgcgttcgttcaggttaatcccgagaaggtcgcagaaaacttaaccaaacaaggcagctatattcccggtgtttggccgggtaaggaaaccgagaattatatctcacggctactcatgcgcttatcaacagtgggtgctttgttccttggtttggttgccttactgccacaactggctgccaacatttgggggttgccgcaatcaatcggacttggtggtacgagcctgttgattgttgtcatgaccgctattgaattggttcgccaattggacggcttactcatgaagcgtgagtacgtcggatttattcgcggtgatttggttaagaacgataagaagtaaacgatatcagaagtcagccattttcaatggttgacgcgttaaaagcagcgtacaaactggcaagtttcagcgttaaatcgtttagaagctgttcacagcagttttaaatacatgccagcgcgtacaattagaggaggatgcaacgtgaatctcattttaatgggacttcccggtgcagggaaaggcacgcaggcagaacggattgaggatacttatccgatagcacatatttccaccggagatatgttccgagccgcgatggctgctggcacagcattaggtaaggaagcaaagggctttattgataaaggtcaactggtacccgactcggttaccaatggcattgtcaaggaacgccttgctgagtccgataccgatgcgggctacatgcttgacggctttccgcgcaccatccaacaagcagaggcactcgaaacgatcacagctgatc

SEQ ID NO: 60 - DNA, 522 bp, Lactobacilllus rhamnosus
gatgccgcggggaattttagggtcactcttgattgccgttttcttattcgtttcggtgggactggttttgttgggaatgtttccatatcaggattacgccaacaatgcagaaccggtcggctgggcgttgcgccactcaggtcacgcggtggtcgcaaccgttgtcgaaagcatcgcggttttaggtatgttcacggcgctcattggtatggcgatggcgggatctcggctactttacagttttggacgcgacgggatgttaccgcatggtttaggaaaattgaacagccgcaagttaccgaatcgggctttggcggtgctcatcactattggcgttattatcggtgcgttctttccatttgcgtttcttgcccagctgatttccgcggggactctgatcgcattcatgtttgtcacacttggcatttaccggctgcgtccgcgtgaggggcaggacattgccaagccacgttttcggatgccattttacccagtgttgccagcggttgcctttctcggatc

SEQ ID NO: 61 - DNA, 670 bp, Lactobacilllus rhamnosus
tggcaacatattgcgcaatcaccgcaagctaaaaaggctggtctgaagctcaaagtcaaacaggtggcagacggcaatgtaacaaattcggcaaccgctgaagggcagttagatgtcaatgcgtttcaatcttacgcgtatttcgaacagtataacaaggcaaatccaagtcaaaagttggcggcacttggcactacctatttagagccgatgggattgtattccaaaaaatataagcgattaagtcagcttcctgatggtgcaacgattggcatttccaatgatccggcgaatgcaacgcgcggtttgttgctgctggctgcggccaagttgattacgttaaagccggattttaatgccttgagtaccgtcaaggatattcaaagcaatccgaaacatttaaagttcaaagaggtggatccttcagttcaggtattgcccgacctagatgcaggcttgatatcaaatacgcgtgctttggatggtgggctaaatgttttaaaggattcgttggtgcatgagaagctgagtcaggatactcgtgccaatgtgaatattttggtgacggcggttaaaaataaaaacaagctcgaacttaaaaagttagtcacgctttatcacaactcaacgattcaggcctggatcaagaagactttttctggtactaaaa

SEQ ID NO: 62 - DNA, 341 bp, Lactobacilllus rhamnosus
gtttattaactgaagagattgcgggcattttcattttaggaacaaatggcgagtcttacgtcttagcggaagatgaaaagttggcatttgtagaacatgttatcgactatgtccatggtcgaaccaaagtactggtaggaacaggtttgaacggaacagcggaaaccattcgcttcagtcaaaaggtagcgtctttaaaaccagacgcaattaccttagttgctccttcatttgttgctccctcgcaacaggaacttgttgatcacggctgggaagaaagcaaccagtacgttgggtgtgacggcagtcaataagacgactttgaaagtaaccctggatcc

SEQ ID NO: 63 - DNA, 732 bp, Lactobacilllus rhamnosus
gatcgcggctatctgagccagtacatggttaccgacaacgacaagatggaagctgatctggatgatccatatatcctgattaccgacaagaagatctccaatattcaagatattctgccactcttgcaagaaatcgtgcaacaaggtaaggcactgttgatcattgctgacgatgttgccggtgaagcactgccgaccttggttctgaacaagattcgtggcaccttcaatgttgttgccgttaaagcacctggctttggcgatcggcgcaaggctcaacttgaagatattgcgaccttgacaggtggtactgttatcagctccgatcttggcttggatctgaaggataccaagattgaacaattaggccgtgcaggtaaagttacggttaccaaggacgacaccaccattgttgatggcgctggttccaaggatgctattgctgaacgggttaacatcatcaagaagcagattgctgatacgaccagcgacttcgaccgtgaaaaactgcaagagcgtctggctaagttagctggcggggttgctgttgtcaaggttggtgccgcaacggaaaccgagctgaaagagcgtaagtatcggatcgaagacgctttgaacgcgacccgtgctgcggttgaagaaggctatgttgctggtggcggtactgccttggtagacgtattgcctgctgttgctgctttgaaagaagacggcgatgttcagactgggatc

SEQ ID NO: 64 - DNA, 1589 bp, Lactobacilllus rhamnosus
gacactactggatccaagtaaggcatcggaaggcgtttccggccaggcgattattgataccatgaatggcctgtacaagtattatggtcataaactacagccggcaatggcaaccaagattgtgaagccaactaacaatgggcttacgtatacttttacgttacgcgatgctaagtggagtgacggcaccccggtcacggcacaggatttcgttttcgcctggcagcggacggtcaacccggccactaagtcatcccaggccaatatgtattccggtatcaagaatgctgacgacatccgcgctggcaaaaaaccggccgcgacccttggcgtcaaagcaatcaacagcaagacgctggaagtcacgttggaacatccgattccctatttcaacagcctgctaaacaatgtcgccttcttcccgcaacccgctaaaaaagtgcaggaatggggcaacaaatacggcaccaagtccgaatacaccctttcaaacggtgcctttaaatccaaaggttggaccggtaccggcgacaagtggaccgaggtcaaaaacaaccgttattggaatcaaaagaatgttcacctgactcaaatcgatgttcaagtggtcaaagacaccaatacggcactcgacctttaccacaccggcaaactggatgatgccacgttaaccgggccaacttgccgcacaacaaaagtaagaccggttatgtcgccaccaaacgcgcccgcacgtattttcttggaactaaacgaaaacaaagtgcccgcgtttaagaacacgaagattcgccaggcaatttcaatggccattaatcgcgattcttttgttaaaaatgttcttgctgacggctcaatcgttgcacgcggcatcaccccggccgacttgagccaattgcctgacagctcaaccgattttgccactgcggttggtaagggcacaaaaacaatcaccacatataacaagaaaaaggcccaaacgctctggaatcaagggcttaaggaactcggcattaagaatgttaatgttgagcttctcggtgatgacgttgatgcagtcaaggcgacccaagagtatcttcaaggaacgcttcaggaaaatctgcctggcttgaagatcagcattgccagcgtaccggccaagaatcgccaacagcgggcatcgacgcgtgattttgacatggtgctaagtacttggggcgcagattaccctgatccgaatacgtatctggatctgttcaccagcaccagtgagtacaaccacggtcaatggcaaaatagcgattacgaccagctcatggccaaggccaatggtgctgatgccaacaatccaacggcgcgatttaaggacatgacgcaggccgaacaactacttgttaatcaagccggtgcgattccgctttatcaactcgttgccgcgcggatggttaatccaaaaatgcacgatctaaaaaccagcccgggtaacagtttcaactttgtctatgcttatttgaagtaaacgaaagccgtttccgctcatcatctgcggaaacggctttttatagtgcgctaacttcaataaacattatctgcatcaaccacaggcg

SEQ ID NO: 65 - DNA, 425 bp, Lactobacilllus rhamnosus
gcaagctgtgtttatctggtatttttcctataaaatcaagctataaaaagaaggaacgattgtgaaaaacatttcggattatcgtaataaaaaggtgcttgtattgggactggcaaaaagcggcgtcaatgcagcgcgcttactacataaattaggggctttggtaaccgtcaacgataagaagcagttcgatgacaacaaagaggctcaggagttgttggcagacgggatgcgcgtgattaccgggcgccatccagttgaattgttagatgagcattttgagttgatggtcaaaaatccgggtattccatacagcaatccgatggttcagcgcgcgcaagaattgggcctgccgattattactgagccggagctagcttttcaggtatccgaagcagagtggatcggcattaccgggacgaatg

SEQ ID NO: 66 - DNA, 803 bp, Lactobacilllus rhamnosus
cgatcgtgtttttagcttatttgggttacagcatctggaacatttggcgttacatccataatcaacggcttaagtggccgcattttgggctgtcgttggataccagccgcctgcccttccatctgccccaagcggtgacggtttttggcattgccttttttgctttgatgacggcagtgagtgaaatgaatcgaccacagttgctgacgcggacctttgatcgtaattacatcgtcaaatatctcgggttggcgccttttacaatttacgatgcagctaaaacggcacaaaacaatcaggtacgggctcaggcagacagtgcaaatctcgatccggttctacaatacacgcgttcgcattatgccgctcctaacgctagctattacggagccgctaaaggcaagaacgtgatcatcattcaccttgaaagcttccagcaatttctgatcggtcaaaaaatcgatggtcaggaagtaacgccatttctgaactcgttgattaaagaaaaagacacgttaagtttcaataatttcttccatcaagtcggactcggcaaaaccagtgacgcggaaaatatgctggaaaccagcacgttcgggattgccaacgggtccttgttcagcagtctgggaacggaaaatacgtttgaaggcgccccggcgattttaaatcaacgcgctggctataccagtgctgtcttccatggcggctccgcttcattctggaaccgcgataatgtttataagagtcttggctataacaattacttttccggcaacttctataatcatgatgaaaaagca

SEQ ID NO: 67 - DNA, 1115 bp, Lactobacilllus rhamnosus
tgtggtcaaaggcgttaatttaaacgttgcaaacaatgaagttgttgtcatgatcggggcgtctggtgccgggaaaagttccgttttgcggatgatcaatggtcttgaaacggtgacaagcggcgagatcttgattgacggtgaagacattgcgcataaaggaacgaatatcaataaagttcgcgaaaaaatcggcatggtcttccagcattttaatctgtttccgaacatgtcggtcatgggtaatattacgttggctccgattgaactaggcattgccagcaaagaagaagcaacccaacaagctaaggagatgcttgaagtggttggcttgaccgataaggcagatgcgatgccggcacagctttccggtggccaacaacagcgggtggcaattgcccgggcattggctatgcatccggatattatgctattcgatgagccgaccagtgccttggatccggaaatggttggcgatgtcttgggcgttatgcgccgactcgctaaacaagggatgacgatggtgatcgttacccacgaaatgggctttgctaaagaagttgctgatcgggtggtcttctttgacaacggtacgatccttgagcaagggacgccgacagacattttcgagcatcccaaagaggagcgtactaagagcttcttaaataaggttttgaatgcctgaggttattcaaatttaatcataagatatgctaaaaaatcggttcgggatattatcctgagccgattttttgagtggtattttcgaaattgctgtcacatttcccgggaaataatccggatgcttagcagaacatggacgtctcacgccaaaccgtggtctaagatacgatccatgacggcggcgacactgccagcatagcccatgccgaacttatcaaggtgaaccatcagataatacagccggtagaattgagcctgaactgatagccgggatcaagtggataaacttcctgatagcccgtgtagaagtcttgggtgaagccgccgaaaacggtcgtcacgccgatatcgagttcgcggtcgccatacaaagcggctggatcaattaacgccggctgacccgtctgctgtgaacatatagttgccacccc

SEQ ID NO: 68 - DNA, 425 bp, Lactobacilllus rhamnosus
gatcaccttgtccaatcaactgacgccatcacgcaacgcccagaaatattttgccaagtatacgaaattacgcaatgcagtggcgcatgttcaccagcaaatgcaggaaaaccaagaagaactcgactaccttgaaggcatcatggcgcagattgatgtagctagtccgaaagatttagtcgatattcgattggaattacagcaacaaggctatctacgtaaacagaaatccggaaaaaaaggcaataaacgccaaaaagtctccaaaccagatcaattctatgctagtgacggcactaaaatctgggtcggaaaaaacaacttacataatgatcagttgaccctacacaccgcgaaaaaaaccgacatttggctgcacgtcaaagatatcccgggatcacacgtgattatcgatagcagtgatc

SEQ ID NO: 69 - DNA, 2271 bp, Lactobacilllus rhamnosus
tggctcgtatcaaatggcgacagttttcaaggacaatttgaatagttgacaggccgcgcggcgaggactgctccatttggtgtaaaccgccagcttgatttgctttttatcttggtaaggcttgggatcgcgttctttaaacgggtaacgtgccacatcgaccgggaaattgataatgtcaatcggactgttagttttgcaatgtgtcgtaatcatatgtgcgcaccaaggccctagtgaaaccatgtgcagtccgaggctataagtacggcgcgccatctggtaacgatcaccgtatgggtagaaataaggttcataatcctggacaaaatacatcttataacccggcttatttttgatgacataaacggattcccataaaagtagcgacccagatgtcagaacggtgcgattcgagttctcccattggcaaacaagttcctttatagcctggatagttaaattcggcgttttgaatcatctcatcttgactttgcggaacgtaacttagatagtaaacgtcataacccgcattggctaacaaggttcctaaatgcagcatggttgtttgaccaccatcaaagccgatgataccggtcgttacaaaagtgatccgattgccgcgcggtttggtttgatcggcaggccgatcgttgaagtatttaagtatctgatcatattgatgaatactaccatcaggagcgtcactaaatttagtttttgcaggtttcacagccattcctcctcaaaatttttcgaacgatgaagtgcaggcaaagactcgaaaattaggcagaaaaaagaagtctggtgtcacgggctgcttgtcagcggcgatacccgattaaactaaaagacgatgcaaatgcctgacgcttattttagtttacataataaccgtaagctaaatagtgatcgttttcaagtttgccaaggttggaacggcgtattctgaatgatagagagggttttgccataatattatgaaggtttgttttgaaatattgccatcggactggaattctttttgtaactggccagtatgatcgtgaagttcgaggacctgcttggccagtgaaatttcagcttttcttcgcgcctgttcaaatcataatgaatgcttatctttaccgtgagatggggctgtgctagtgtgaaagtatcgatatcaatgaaagaacaggtgaacctatgttaacgattggagtcattggtttaggcacgattgctcaaaaagcatacttgccagtttacgcgcaaatgcaaaatcaagtgcactggttattgaatacacgcaatgaagacaagttagaacagctttcagcacagtacgggcttgaaagtgcaggccattcgctacaagacctcgatggacaaccacttgatgcggtgatgattcatacaccaaccgcgacccattatcagtatgttaagcattttttggaaaaaggtgttcatgtttttgtggataagcctttagcaaccgatatggcgcaagttaatgaattatatgatttggccgatgcgaaacatgtcatgctgacggttggctttaatcgccggtttgccccaatgattcaagatttagcgcaagtgacagataaaacaggcgtccgcgttgataagaatcgcattgatgcgcttgatgacaccgaacatgcgctgtgggatcttttcattcatccggtagacactgcactgatgctcgctggctatccggaaaaaccaaacacccgctatgccttgcacaccacaagtgatggccaacttcaacaagcaagtgtcactttcacagctcccggtattcgtggggaagctggaatagatctgcaggcaggaaccaacctagaagaggcgcaagtggcagctccaagcggtgtgcaacgcgtccaaaacttagaccaactggttgtgtatggccgtggcggtgcttcacaaacttttgccccagattggcagcctatgcttgaaacccggggatttgcgccaatggtacaggcatttgtccaggccgtgggtaatccagatggccagaatccggtatcaccggcaaccagtcaattagcgcacgctgttgtcgccgatttggtcaatcaaattaacaactagacagggtactaacccaaaatgcttttgaagatcgataaaatgaaatctgccagcttgaacatgagtgtcggaccagcagataaggaaggggacaagtgctatgtatcaaaaatcatttatggcaatggctgatgaagaagcaaaagcaaatgttaacggatc

SEQ ID NO: 70 - DNA, 1030 bp, Lactobacilllus rhamnosus
ctgaggtttatgcagacggcttttttgtgcacactttttgtacaaacaccatcactaagcgactgcaaaatagttgcggtacaatagcaccaaagcggtgaaaggaatgaagggttcatgcacattgcagtcattgatgatcaagcagcgactagagaagcaacggtcaagctcattcggcagttagcgcaaccgtcacagccattgcaggtggcggcttattcaaatgccgagcagttcctgtttgcagaaaaatcagccgatctgctgttgcttgatattaagttgggatctggcatggacggcatggcgcttgccaaaaaaattcgccaacatgatcccgaaaccgccatcgcttttgtcagtaactacgacgaattcgtgttcgatggttacgatgtgaacgcgattgactacatcctcaagccgcttacggtggcaaaactcaaacacctaattgaaaaggtagctagccagacgcagccaaaactcttggcattgcaaaccgctgccggtctagtacgcgtgccaatgtatgacatcagcgccatcgaagtcacggatcaccggcttcaagtccatacgcaaaaaaatcactatctggtaaacggacagttaaaagactttttaccgcgcttagatgacaactttattcagatttaccgctccatcgtcattaacctgaatttcctctcgcagctggataaacgaaccgttgtgatggcagatggcaccacttatcccgtttcccgccagcaggcaccgctagttaaacaggcattcttcaagcattttcgggggttgacccatgacagcaattagttggttctggctggtcgcctttgggttgctagtagtaggttgtatgtggcagttatggtggatttttcggcgccagcaaaactggccggtgcgctggttaaacctcatcattgccatcgtatcgttgagcagttggtggttatggccgcttccggttgtccgcggcttgctttttaccatcactgtgttagcaggcagtttggagttc

SEQ ID NO: 71 - DNA, 791 bp, Lactobacilllus rhamnosus
ctgatctgaatgagagtattgttgattttattcgggacttttctcagcctgaagctgctttgacgggtgctgatggtttgtatttggcagaagaggggatttttgatgccattgtgctggatattatgctgccggagctgaatgggtttgatttgcttaaacagttgcgagctaagcaagtgaaaaccccggttcttattttgacggctaaagatgctttgacagataaggtgcgtggttttgagttgggtggtgacgattaccttaccaagccattccaccgtgaagagctcattatgcggttaaaagcattgttaaagcggacaggacatttttttgatgaggatgggttaacagccggtccgtttgaagtccacctaaaccggcacgaagtcttaattcacgacaaaccagtagcgttgaatggaaaagaattcgacttgttagtgtacttattacagaatcaaaaaaccattattacgaaggatcagatttttgatcggttgtggggatttgattcggatacggccgtcagtgtcgtcgaagtttatatgtcgaacttgcgcaaaaagttaaaaccgatgcaagccgacgtatggatcaaaacaattcgcaatgtcggttacatctttcaggaaccggaggaccgtgcatgaatgcagataaaggcattaagcgacaacagcgacgtttatttatcggtcaactactgagcttcgccggactttttctagtgctgggggtcattgtttttttcctttatgaacgttcgatttatcaagatatcgatc

SEQ ID NO: 72 - DNA, 623 bp, Lactobacilllus rhamnosus
aaactgcaccagcaacagcgtataccaagatggacgattttctcggcagtgatgtcgatgtggtgtatattgccagtcctaacagtttgcatgcgtctcaagccttggcagctcttgatgccggcaagcatgtgattgttgaaaagcccttggttgcaaccgctatggaatttgaaaaactagacgaggcattacgcaaaaagccttctttgtatctttttgaagcagctcggcatgtttatgagcacaattttcaggttgtcgatcaatttacccatcatcatccgattgacggggctaccttgacttatatgaagtattcttctaagtacgatgcttttttggctggtaagttgccgaatgtttttaatcccgagtttgccggtggtgcattgatggatctgggtatttatttggtctacgatgcggtggcttggtttggggttcccgataacgctgtttacctcccgcattttctcaagagtggtgtggatggcgatggggttgcgcgcttggattatgatcaattcgccgtgacactgattacgggaaaaacaaccaatagtttcctgccatccgaaatttattccggtaagcaaacgttgactatggacaatgctgct

SEQ ID NO: 73 - DNA, 1420 bp, Lactobacilllus rhamnosus
gtagtcaaaaatctcctctggaatatggggtaccaagttttcattcttttacttccgattgttactattccttatgtttctcgagttcttggaccgacaggaattggcatcaatgcatttacgaattcgattgttcagtattttgttctatttgggacattggggctaacaatgtatggaaatcgcgaagtagcctatcagcgcgacaatcctaaacgtttatcaggtttgttttgggaattaaccttgttaaggcttgttacgacaggcattgcgacgctgctatatttgggcttcatattgctgtcaggagaatatcaagtcttctatcttattcaaggacttttgctggtagcgacagcgattgatgtatcttggctttttcagggtcttgaagaatttcgtattaccgtgttaagaaatactttggttaagatcatttcgctgatactgatctttgtccttgtccgaacaaagaacgatctttggctctacatcctaattcttactggttctcaagttctggggaacctaacattagtaccatatttaaaaaaatacgttgttgtgccgcattggtatgatttgaaagtcattgatcatttacgtccgacaatcgaaatgtttgttccgcagattgcgacacaagtatatctacaagtcaacaagacaatgctgggagcccttgttggggttcaggcatcaggcttctatgataactcagacaagatcgtcaaaatattacttgcagttgtgacagctacggggacagtgttgcttccgcacacggcgcatagttttgcacaaggaaaacatgatgaggttgaagcatcattgaataaatctatgcacttcattcttgttatcgcatttccaatgacaactgggttagccggaatcgcaccaatattcacgaaaatcttttttggaaagggcttcgacccggttgctaatttattagtgatcgaatcgatagttattgtacttattggcatcagtaatgctactggggttcaatacttactaccaactaatcagcttagaccgtttacgacatctgttgtttttggggctgttgccaacatggtattgaatgtgcccttcatcttaatttggggcagcaatggagcgatgattgcaacggttctatcggagttattggtttctatttaccagttaagtaaggtgagaaaccaacttcggatcaggtcgctttttagtgaagtatggaagtatttggttgccgcgcttttaatgggagttagcgtacgagtttttatcaatgtattaccgttgtcaaactttctcgctttgttaggcgcaacaatgtatggagctttgatatatacgcttgcgttagtcatacttcgtccaaaaattttattgcaaatgatttcatctttaagaggccttaggtaat

SEQ ID NO: 74 - DNA, 679 bp, Lactobacilllus rhamnosus
gatcggatgacggcttttatccaaacgatgagtcatctttccgcgcttcaaaaccgtcagctaaccggtgaggcgatgacgccggccaccttggaacaacaacttaaagaagaagctagcaaacttgttccggctaccaaaacggttacttggaaggtcgagaaccagatgacaacaaacgagtcgcttgcaattgcaccggatgtggtacttgaagttttcgataatcaactgaccaatgcttgtcggtttgccgctgagcaggtggcgattcacttaaccgcaacggcaaacgggttgacgataaaagttgataatgatggtccgccgttgactccgggtgaacaagctaaagccaagttgccgtatttttccagtgaccgtcaagcccaacatctcggggtcggtatgtacatctgtacgcaattatgcgcggcgcatcggggtcattttacaattgccaatcaaccagatacccaaggcgtcagcaccattgccgaatttggttttttaacgcctgcctccagctcgactgattgatcaagtttgaaatttttgcttgggtaattaatggcgaatattttggatgtaagctgattcctgagacagcttcttagcggtcatttgaacgctaagtacagaagtggcttttagtttatatcaagtaacagttagctca

SEQ ID NO: 75 - DNA, 487 bp, Lactobacilllus rhamnosus
tctaaccgcgctggctcgcgctcactacaaaaggggagagtagatgtcgttaccgatatttttagaactggttgaaattcgcaccaaactggcaagtgttttgccatttgcgattggtactttgtttgcagtgacttattttcacgcctttgattggctcaatacgcttttattttttactgcaatgttgattttcgatatgatgacaactgcgcttaataatttgatggattatcaaaaagccaaagatgctcattatcagcaggaagtgaatgtcattggtcgggctcagcttgatccgggaatggttgccaagttgattctggtaatgcttgtggttgcttcgttgctgggcgttgtgttggtcgtgcggacggattggctgttgctgttaatggggatggcttgttttgccattggtattttgtatacttgggggccattaccgctttctcgtttgccgcttggtgaaattttttccgggatc

SEQ ID NO: 76 - DNA, 1136 bp, Lactobacilllus rhamnosus
ggcactgaggtacaaaacacggcggtacagcgcatcattgaaacttttcaggcagaactcactgggccaaatgcgctgaagtgattggaaccgccaccatgcaggcgtaaactaaaggtgtggttaatggctcatctgaaaggaagcatttattttgaaaattgccaaattaaacaaccatccctatctgataacgtctgcatcaacagcgcaacccattaccaatgctgccgatgttttgacagctttaacccaccgcgacaccttaacattcggttctgaaattaactttaaaccggaacaattagaggcgccggtagctgctagttcccagatttttgctatcggaatgaattttcttgatcattcgcaagagattcacatcaagttacccgaagttccgagcgtcttcactaaattcagtagctcgctgaccggtccgacaagtacggtacctatccatgggcccaaaaccgattgggaaaccgaattagtcgtgttaatcggtaaaggtggccgcaatattgccgaggctgatgcacttaagcatgtcgccggatttttggttggcgaagacttcagcgatcgtgccgtacagtttgccaatgccgaaccgcaattttcgctagccaagtctttccaaaactactcacccattggtccctgggtgacgtcaacagatgccatcacaaacctcgaccaattacaaatcacgaccaccgtaaatgggcatatcatgcaacaagccaaacttgatcaattgatttttaaagtgcctgctttaattcactatctcgccgggattgtggcgctacaacccggagatcttatctttaccggtacaccgagtggaacaggcgtgggccgtgacccgcaaatctttttgcaaccgggtgatcacgtgacggctgccatttcacagttaggggcattgaacctgacaatgccaacaccgcaaaactaagacaaccgattccaaccatcaaaacctataccattttaaaaacaactaggaaaacgccaccatatagcgtatcctgaagatgtctaaaaaatctaagaggtgaatttgatgttggaaaacaataactttgatgaagttgtcatgaagcgtcatactgcccgtgaatttgatc

SEQ ID NO: 77 - DNA, 746 bp, Lactobacilllus rhamnosus
aattcaaacgagcagcctttaaaaaagtttccgactggcaaaaatatttgaaataggtgattgaattgaaacgtattatcgtagggattaccggggcatccggaactatttacgctgttaacctgctccagcatttacatcgcctgcctgatgtcgaagttcatttggtgatgagtgcttgggcaaagcaaaacctatcacttgagaccgacatgaaacaaagcgaactcgaagctttggcggattatgtttatcctgttcaaaaccaaggggcaaccattgcaagcggcagttttttaaccgatgcaatggtcattgtcccagcaagtatgaaaaccattgcgggcattgcgatgggctttgatgataatctcattggacgagcagccgatgtcacgattaaagaacagcggcaattgattattgtgccgcgggaaacaccgcttagtccaattcatctggataacctcgctaaactagcccacattggcgttcaaatcattccgcctattccggctttctatcagcatccccaaaccatccaggatttaattgagcatcacaccatgaaactattagacgccttgcatattaaaaccgaaaccgctagtcgctggaatggagcgtcgttaagatgaaaaaagttctcaataaacagagtatcggttttctcatcggcattgcggtgggcctcattgtttacctggccccactgagcggcatcaatgaaaaagcgcaaatggatc

SEQ ID NO: 78 - DNA, 1442 bp, Lactobacilllus rhamnosus
aaagatatgagtatggtcattctggcgccacaaatggaaagtatgaaggataatttgaaaaagattaccgataaatatggcgttaagttggttacaaccactggtcgccagtacattgaactgacaaacaacggtgatatggcactggattttgttgagtccaatctttaggtgttcaacaacttagacagactcgtctgcatactttataggaggaagttaaaacatgcgtaaacaattacccaaggactttgtaatcggtggcgcaactgctgcttaccaagttgaaggggcaaccaaagaagacggaaaaggtcgagttctttgggatgattttctggaaaaacaagggcggtttagtcctgaccccgccgctgatttttatcatcgctatgatgaggatttggcgttagcagaagcatatggtcatcaagtaatacggctttcaattgcctggtcgcgaattttttcggatggtgccggggcggtggaatctcgtggcgttgctttctatcatcggctctttgctgcctgtgccaagcatcatcttatcccgtttgtaacgttgcatcattttgatacaccagaacggttacacgagattggtgactggctgagtcaagaaatgctggaagattttgtcgagtacgcgcggttttgcttcgaagaatttccggaaatcaaacactggattacgatcaatgaaccaacgtccatggcagtgcaacaatatacgagcggtacttttccaccagcggaaaccggtcattttgataaaacatttcaagccgaacataatcaaatcgttgcccatgcgcgtattgttaatttgtacaagtcaatggggctagacggtgaaatcggtatcgtgcatgccttgcagacaccttatccatatagtgattcgtcggaagatcagcatgccgctgatttacaggatgcgttggaaaatcggctgtatttagatggcacactggcaggagattatgcccctaagaccttggctttgatcaaagaaattctggcagccaatcaacaaccgatgtttaagtacactgatgaagagatggcggctattaagaaggcggcgcaccagcttgattttgttggcgttaataattacttcagcaaatggctgcgcgcttatcacggcaagtcggaaacgattcataatggtgatggctcaaagggatcgtcagttgcccgccttcacggtatcggcgaggagaagaagccagccgggattgagacaacggattgggactggtccatctatccgcgtggtatgtatgacatgttgatgcggattcaccaagattatccgttagtaccagccatctatgtcaccgaaaacggtattggattgaaagaatccttaccagcagaagtgacgccaaatacggtcatcgcggatcccaaacgcattgattatttgaaaaaat

SEQ ID NO: 79 - DNA, 793 bp, Lactobacilllus rhamnosus
tttattttgcggccggtaacgacctgccttaagcctaaatgccattttgattggtagctatcagacaccaactcgtaaatgacctaaaaattgacacatttaatctttctataaagggagtttcgcatgaagaatcgactcgatgatattacagatttaatggcacttggtccgactccggatgcccgtgacattcagcgacgtcaaaccgcccaccgaatcgcaattgcagacgcttggcaaattcaaccaggcgaaaacatcttggaaatcggctgcggtcaaggtgacttaagtgcggttttggcagatcaagtgggtcccagcgggcatgtcaccgggatcgacattgcttcgcgcgattacggtgcaccgctcacactcggacaagcatgggatcatctgttaaacggaccgttagcaagtcggctgacagtacactttgataccaatctcgccgccagcctcggaccggttgccaatcaacattttgaccgcattgtgatggcgcatagtttatggtactttgcatcggccaatgcgtttgccttgcttttgaaaaacctgcgcaccattggcgattatgtcgatcttgccgaatggtcccttcaccccaccgcgctcaatcaaattggtcatttacaagccgcgatgattcaagggttactttatgcgattgcgccaagtgatgttgccaacattcgcactttaatcacgcctgataccttagcgcagattgcccatgataacacatggtcctacactgctggcaagctaatagaatgtccggatc

SEQ ID NO: 80 - DNA, 156 bp, Lactobacilllus rhamnosus
aacttatacaggcgcaacgattggtcacctttctgccgcccagaaaaaggccgcttaccgatttggccggcagctcggcatggcctttcaaatgattgatgatttacttgattatacccaaactgccaaaacattgaataaaccggcgcttgagga

SEQ ID NO: 81 - DNA, 847 bp, Lactobacilllus rhamnosus
acgctaaccgactggcaaacagcaattaatcatactttagacgaacaattggcaactgtggtcaatccccatttgcgtgcggcgatggcttattcggttgatgcaggcggcaagcggttgcggccgttgctgttattgagcgttgttgctatgtacgatggtgtggttgccgaggcattaccggctgcagctgcacttgaatttgtacatacctattctttgattcatgacgatttgcctgctatggataatgatgatctccgccgcggtcagccgacgaatcacaaacagtttggcgaggcgctcgcgattttggctggggatgcattgttaaccgacgcattcgctatcttaagccagcactatccgggaaaaggtgccgaactcgttcaaattctggcagaagcggctggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagctgccttagccgattttgcggctgcttttggtctgggttttcaaatcaaagatgatatcaatgatgtgactaaaaccaccgcggaattaggtaagactgccgataaggatgtggccgaacacaaaaatacatttcccgaactgctgggattagccggtgccaaacaagcattggcgacccagtttcagctagccactgctgcgttaaacagcctgaccgttgatgcaaccgacttaaaatcgattttggcggtgttacaagcatgacaaa

SEQ ID NO: 82 - DNA, 340 bp, Lactobacilllus rhamnosus
gaacagattcagcagcggctggaacaggtcgttactttacgcgaaccacaagtgcatacgttgattcagcagcaaatcaatgcaggcggcaagatgttacgaagcgggcttatgcttatgctagcgcgttttggcgaacctgtcaacgctgagcttgtgacggctggtgctgcgattgaagcactacacctagccacactggttcacgatgatgtgctggatcatgccgatattcgtcgcggcatgaccacggtttctgccgagtccggaaatcgtgaagccatctatgccggtgatttcctgtatgcaatctattttcaattgcttagcgaacaggatc

SEQ ID NO: 83 - DNA, 300 bp, Lactobacilllus rhamnosus
cgcgaaatctggcctataaagcggcattggcgctccaacgccatgccaatatccgccaaggtgcgcggattcatattgaaaaacacattcccgtcgctgcaggtttgggcggtggttcgagtgatgcagctgccgttttgcggggcttaaattcactattgcagttaggttatagtcgctcgcagctggctcgcatcggcttacaggttgatagcgatgtgccttactgcgtttactcggagacggccttggttaccggacgcggcgatgtggtcacgccattgggaagtttaccgaact

SEQ ID NO: 84 - DNA, 121 bp, Lactobacilllus rhamnosus
gccagagaagtggtatctggtggcgcaccctggtgtaagtattccgactccggtgatttttaaagatcctgaactcccgcgcaatacgccaaaaaggtcaatagaaacgttgctaaaatgt

SEQ ID NO: 85 - DNA, 941 bp, Lactobacilllus rhamnosus
ggaccttgaaggaaacttatccggctatttttgtggtcgatctcgaccagaatgaaaatgcgttcgagcgtgtctcttatagttacgcggatcttctgactaagtcaatcaagatcaccttcgaaggcgaagaaaaagcgtcataatttcagatactaaccgacgattaaatcgtttattttgagcaggcctcgatgtcattggcatcgaggccttttgctatcttcttgaaagactgatctgtacaaggtgacgaatttttgacacgcggcaatgaaaatccggacgcaaaacagtatactgaaaataacgatacggcggatgcatgcatcgtcgtttgcagtgtgagctctccctgtaaatacatgcatcgccagagactggtggttagatggaactgatcgagaaagcgccggccaagattaatctaagtttggatgctttgtatcgtcatgctgacggcgaacatgagtggcagatggtgatgacatcagttgatttggctgattacgtgagcattaagcctagccatagcattcaggtttccacagatagcggttttttacctgaagatccgcgaaatctggcctataaagcggcattggcttaacttctatcatggaaggttttgatctctcattactggaggcgatttcgcatggtgttgtcggcgtgacctatgacgttaactacggtccaaacgaaatcgtgcaagacggcatcaatgggtatgtgactccgtatggcgatattcatgccttagcggagaagattcagttattgctatccgatcgtgacaagatgcagcagatgagtacgaatgcatacgaatctgctaacagatattctgaagaaaatgtttggaagaaatggcccaaagttttaatggatgcacaaaagagtgaggggaaggtgaccaaatgatttacatgggtggtgaa

SEQ ID NO: 86 - DNA, 326 bp, Lactobacilllus rhamnosus
gatcggtttgacgacagcacgccctgttttgtacgaccggattaatgcgcgcgtggatactatgatggcagcaggcttagaaaatgaagtcgccaacctgctaaaaacggttcccccggatgcgcaggcgctgcaggcaattggctacaaagaattgatcccgtactttcgcgggcaagctgatttagcaacctgtgtggccttgattaaacagcattcacgtcattttgccaagcgccaactgacctattttcgcaaccagatgccaacacattggtttgacttggttgcccatccagaagaaaagactgctgtccgttgctttg

SEQ ID NO: 87 - DNA, 363 bp, Lactobacilllus rhamnosus
gatcaagcggacttggcggcccttggcgtcagcagtcctgaactcgatcgactgattaatgttgcccttgataacggcgcatatggggcgaaactgaccggttccggcatgggcggctgcatgattgcccttgccgccgcggaccaggcaccggcaattatccaggcactaaaggtagccaatgccgttaaagtctgggaataccactttgaaacgaaatgaggctgctatgacaacttatgcacgcgcgcacactaacattgcattgatcaaatattggggcaaagcaaataagcaattgatgctgccggcaaccagcagtatttcgcttactctaaatgacttttacacggacacggcggt

SEQ ID NO: 88 - DNA, 493 bp, Lactobacilllus rhamnosus
cgcagatggcctattcagttgctaagtttaaagccgcagctgaggcagccatcacggacgtcagcagtcggcgccacctgccgattttagttggcggcaccggcttttaccttaacagtttgcgcctgaatttaccgctgggtggcaaggcaccgccgactgcagtccgtcagcgttggcaggcagcattggcagaaaatggcgaacactggttgtgggagcagttgcagcagcaagatccagtggcagctaaccaaattgaatcggcaaatacgcgccgggtgattcgggccttagaagtcatcgaattgacaggtacgcgcttttccgagcagccgcagccgcaaccacgctatgagacgttggtgatcggtttgacgacagcacgccctgttttgtacgaccggattaatgcgcgcgtggatactatgatggcagcaggcttagaaaatgaagtcgccaacctgctaaaaacggttcccccggatgcgca

SEQ ID NO: 89 - DNA, 322 bp, Lactobacilllus rhamnosus
atacgttatgggttccggttttaggtaatgtcaatgccacttggttttatgtgatattcgttgttttttggctcgttggttttagtaatgcggttaatctgacagatggtttggatggcttggttgccggtcagacaaccatttcatttgcaacgtatgcagtgattgcggttcgtgaaggccgcgttgacgtgttgattatttgtctggtgactgtcggcgcgatgcttggatttttgatgttcaatcataaaccggcccagattttcatgggcgatttgggatccttggcattaggcgggatgctggcagttgctgccat

SEQ ID NO: 90 - DNA, 716 bp, Lactobacilllus rhamnosus
ctgatcatcatctcggctatttgggtcagcatttggcagcaccaattaacgctgagtgtctggatttccttatttattttggttctttatggcttgttaggattttatgatgatttccagaaattggtgcaccatcgtaatgaaggcttaaaggcgtggcaaaaattagccggtcagattcttggcgctgtcatttttctgatccgcaaaatcgcagtttcggtatcaccaatcagctgtttttggatattgctaaaagcggctgcaaaggcttgctgcttggtttcacctttgccagataccgtgacgacttgatgtttggtttcattgacgactgtcatttataaccgcactccttacgcttcgggatacttcttgttccacgcttcgaccagtgctttacccaacgcttcttgatccataaagccaaaaccgagaactttagtgccttcctcgatggcagtcacaccttcttgaatcgagcgcatgccatgacgttccggccatccatattgcgtatgcgcggtaatcgcccccgcaccaccggaaccacagaagctaatgcccatatcggctttttctttatccatcacctgacccaaacgcatatccgcccccataccaggcaccacaacggcagtaccaccagcggcttcaacccctttagcaacgttttgacccttacccatccgatctgcgataactactttaaccat

SEQ ID NO: 91 - DNA, 465 bp, Lactobacilllus rhamnosus
cggcacggattcccgcgcatattgcgattatcatggatggtaacggtcggtgggcaaagcggcgattgttgccgcgggttgccggacacaaacaaggcatgcaaaatgttaaaacgattaccaaggcagcaagtcgtctcggggttaaagttttgactttgtatgctttttcaactgaaaattggaagcgccccggttctgaggtgaattacctcatgcgcttaccggttgacttttttaacgattttatgcctgatttaatcaaagaaaatgttaaagttgaagttatgggtgagttaaccgacttacctgagccgacacgcaaggcgagtgaaaaagctatggcggatacggccaacaacaccggcatgattcttaactttgcgctgaattatggtggtcgtgacgaactggttcacgctgcccggaaactggcaagcgcggtgcgtgatggtcaattagatc

SEQ ID NO: 92 - DNA, 402 bp, Lactobacilllus rhamnosus
gcttatagtgagctggtgtttgtcgatgattattggccggatttctcgcctgctgcattggaggcggcgatcgcaacttaccaggctagagaccggcgttttggcggtttaaaaaaataatcaactaaataaatggtgatggaggatttgttatcatgaaacaacgggtcataacggctgtcgttgctttggcaatttttattccaattctaattgccggtggcggttggatcgatacagccggagcagtcttagcgctaattgcgttatcagaagtgtatatcatgcggaagcgcatcattctttcgccagattttctgattgcatcgcttggtatcttggcggtggttttgccgaatagctttttccgttggctgcctgcctttttagggcggattgatc

SEQ ID NO: 93 - DNA, 921 bp, Lactobacilllus rhamnosus
gggggattattatttagttttgaaatattggaggggtaaatttggaaacagcatctgaacatagacggaccgacgttgagcaagttaatcttgggggattgacaccgacctacctagtgtcaaagcgttgttttgacgttgcagccagttttatcggtctcgttctgctcagcggtgtttttttagttttagcagtactgattaaattagatgatccgcatggaaaggtattttattcacagactcgactaggtaaagatggacggcgttttcagatgtggaagtttcgttctatggttgctggtgcggataagatggttgacaagttacttaaaaagaatgacgttgatggtgcaatgtttaaaatcaagcaagatccgcgtgttactcgtatcggccgtgtcatacgtaaatatagtcttgatgaactaccccaactttttaacgttttacgaggtgatatgagtttagtgggtccaaggcctcctttgccccgcgaagttgtaaagtacactgagtatgatagacagcgtttggctgttgttcctggagtaacgggtttgtggcaggtttcaggtcgtaatgagcttggctttgacgaaatggttgctttagatattcactatataaatcatgctagtgtcgctgaagatttcaggatcttgttcaaaaccattcttgtggtaattcatccgacaggtgcgtactaattaattgttttaaaagttagctctattcagtttaattgtatgtttattcgtgagaaaagttgaatcgtaaaattttgacttacgaataataagcattgttaaagagtaaatctatcggtgagtgtggctctccaaaggggagtcttttttgttatactatggcgggaatctgacaataagcctcaataataccaatcctacaaagtactcg

SEQ ID NO: 94 - DNA, 258 bp, Lactobacilllus rhamnosus
ccatgtcggcaacggcagaggcaaagtctggcccggttcttgctaaagcgcacgattcgcgaattacaccagttggcaagtacctacgcaagttccgattagacgaattgccgcaaatttttaacgttttaaaaggtgacatgtcaatcgtggggccacgtccagagcgtccttattttgtcaaccagttcaaccagcaggagccgcattactacctgcgtcacaatgtccgggcaggtattacggggtatgcacagg

SEQ ID NO: 95 - DNA, 2499 bp, Lactobacilllus rhamnosus
gcgccggaatcctgccaatggttcgtcatcgaaactagccaaaaaagccggggcgtctgagcctaataactgggtatatttttctttaaacgcttcaggaagttgcacttgttcgatcctttaaattatccggaagagacttttcaaagtttcgacagcgcttttaacaacggagctgattacgttgagcttgacgtacatgaaagtgcagatggtgtgattgtgattcaacatgacaccacgattcagcgaacgactggtgccaacttggcgatcgcgaaaacaaacttcgcacaacttcagcaatatcataccaaaaatggcgaaccgattcacagcctagaggaactcttcgcccatgagcaacaaacaaagcataaattcctgattgaaactaaaattgtaaaaggtgaaccgcatccgcatctagaagacaaagttgcggccctgatcaagcaatatcacatggaaaatcgcgtgatgtttcattcattctcagcagctagcctcaaacgcttgcaagcagctctgccaaatattccgcgaattttgatcgttggctcgcttaagcggatcaactttgacgtcttgacgtacgtggacggtattaatctaagttccgatttagtgacgccgcaacttgtcacccaactgcatgatctaggtaagaaagtttatgtttgggatgaaatgaacgaggatcgggcgaaatggacttggctcgtcaatctcaacattgatggcgtcgtcactaattacaccagcctcggccacgaatttcaaacgcttaaggcagctgctgtcaccaccagcatcaatgatcttggcgcaaactcaagccttgctgcactgccagtttatgaaaatccttatcagccattgttgcgctctgaacggctggcaccgcaaaccccgatcatgatttccagcatggtttccctcgctggcagcacgtactaccaaattggcgataatgcatttgtccctgccgaaaccattaaccttgcccctgaagccggttgggcaagtctttttctccatcagcgcatcgtcatcaccagccggcactttaaggtacccgtgcacgctgatcccttacatcagcaagccattaccggccatgttggcaatcacaaatgctaccgggtattagcagcccgttatcaaagcggccagctgtatttaaaaacaaaaatcggttggttaaacgccaaagatttacaggtgctgccaaccgccgagaatatgcgcatctggctcacgctctatcgcagcatccccgaaaaccaaaaaccgctccttcactgggcacttggcgacacggccttcgatacaccgcttctcaatgccagtgtcctgaacatcggttaaaaacttgagttgccctatcaataagttcgtcgtctgtcttcaccacgcattatcaatgatcgagtcattcattcgtgtctatgccttaaacatgctattcttaagacaacgctattaagaaagtaggttaaccttatgaccattaattggcagcaagaagttgaaaaattggaaccccaacttctctcagatctaaccacacttttgaagatcaattcggaacgtgatactgatcatcaaaccgatgagtatccactcggaccgggaccggccaaagcgcttgaagcatttttggcgattgcacagcgggacggtttcaaaacattaaatgtcgaccatgttgccggccgcatcgaattaggcgatggcgatgaaatctttgggctttttggccatgttgatgtcgtgcccgcgggaccaggctggcaaaccgatccatttgaccccgttattcgcgatggcaagatttatggccgcggaacaagcgatgacaaaggcccaagtatcgctgcttactatgccttaaagcttattcgcgatctcaagttgccgattaataaaaagattcacttcattcttggtaccgatgaagagtctgactgggtcggtattcaccgctatctcgaaactgaacctgctcccgacttcggattttcaccagacgcggaatttcctatcatcaatggcgaaaaagggattgctagttttgaaatcgttcaaaaaccaatcgccgctgcaaccgctgatctaacgttgaatcatttttccgccggtattcggccaaacatggtgccacaagaagcaaaggctgtcctcagcgggccattaccggaagcatttgtgacgcaagccgagaaatgggcagcggagcaagaagtcaccctcactctgacactaggcaacccgacaacgattgaattgattggaaaaggcgcccatgcccaagaaccaaaagatggcaaaaacgccgcaacctatttagcaacgcttttggccgacttaccatttgatccagccgggaaagcctatctgaccatgattgccaaccaccttcatctggactcacgtggtcaccatttagggattaattataccgataaactaatgggtgacctgaccgcaagtccg

SEQ ID NO: 96 - DNA, 2039 bp, Lactobacilllus rhamnosus
atgggtacccgcccacggttcgcgaaatcggtaaatcggtcggactcagctcttccagtacggtcgcggcttacttggagaagttgctggcggctggcttgattgctaaagatccgtctaaaccgcggactattgaagtcacagcagcagggcttgattttattggggttcaggcacaaggaatcccgattgtcggaacggttgccgcgggggttccaattacggcgattgaaaatattgatgattattttcctgtccctgacgatcttccgtattccgccgatgaattgtttatgcttcgggtccaaggcagttcgatgattaagatcggcattttagacggcgatcagattattgtcaaaaaacaaaatgatgccgaaaatggacagattgtcgttgcgatgaccgaagaggatgaggcaacggttaaacgtttctacaaagaaaagcatggcgttcgtctgcatccggaaaatgatgatatggatgacatgtacttccccagtgtcacgattctcggaattgtcgttagtttatatcggccggcgcttgtgtaatcagctcataattcagtaagacgaatcgctctcacatcaaaaagacatttaccaactactttattcgaaagtggtgggaaatgtctttttgattatgtatcctgatgtcaacgttgcaaatttcaaagttgggcgaggcgaactaactaaattactcttggctaattaacggctgtctgaactgattagtcggctaaacgaatggtgccgctcgtaaccaccatggtaccttgggccgtttgtaacagtaaggcaccattatcatcaaacccgctgatggttccggtcagcgggttttgtgtgccactcaccgtaattcggcggccaacccatgcagcttttgcgcgataaatcggcataatggtttccggattggcaaatagacgcatcagattggttaaaaatcggcctgccaattctggacgcggatcgctatctggctgattggcaagtaacgtggtgatcggctgatcggttggcagcactgctgattgagccggaaaaagatcaactccgatgcctaagaccacagcgttgtgttcaatgagtgcttccgctaaaatgcccgcaaccttgcgaccacctttttgcagatcattcacccatttgatcgcggttacaatgccaaactgggtttcaattgcctgctgcaacgcaacccctgcagctggtgtgatcagggactgactgatttgcggatggaatgcgtaactaagataaagccccgcatcggcaggactggcaaaatgtttgccatggcggccgaccccggcagtttgttcaccggcaataagaatttggggaaccgtactgttattttgaacggcgtgttttaaaacggtgttggtagaggtcacggttgcttgagtagcaacggctgcacgcaaatgaggatcgtctaaccatggatctaaagcatgaggtgtaaacatcataagcttcctttctgatttgcatcgcacaaacgccaggagtcaccgcaacattgtgagttgccgacttctggcgcttgggttgcatgattagtttaaagagcgtcaaggcgttagtgttcgcagcgcaatcaagcgggcaaagtcacatcactaaccggctaattgcatcggcatagatggcgactgctgccacaatgtctttgatcggcatatattcatttgcctgatgcatgacattttcctggcctggcatttgggcaccaaaggcaacaccgcgtttgatgatacgaccataagtgccaccgccaatgacttgttcatgaccggggatgcctgtgtgatcgctaaaagtctggagcaatgtcttgacaagtggatcgtcaccggatacatagtgtggttcctgagcgtgaccgctgactgccacattgtactgatctgctcctagcgccgtttcaatctgatcacggattttggctgcatcggttccttgcgggtagcggacattgaccagaacgctttggggaccgtcttgcgtaaaggtgaa

SEQ ID NO: 97 - DNA, 11935 bp, Lactobacilllus rhamnosus
gatcccggaagaaattgcgcgcgtgctaggacgggatcagcaggcaaacaaaaccgttgacctgctcgtgcgacggcggttttgggatgaagaaccgatgaccgttgagcacgttgcaatttgccatgaatacattgaaggcctgcaagcacacgactttgagggctcgctttttgccttaattgaaaagcgggtgccgattgcctattcgcatcaggaagtcgaagccgtgctgatcgacccagacatgatcaaattactccacgggaaaaaagacgatccgttactactcgtccattccgtcacctatactgccgatgccaagccgattctttacgatatttcgtactatcgcgctgacaaatattcgtttaagtccacgttaacgcgggatcgggtgtgaatttaaggaagtaagtgcgaatgaaaaatgaaacgctagcagctttatatgaggcgcaacggatgacttttatccaagcattgcgccaaatcatgcaaattaaaagtgttcgcgggtcgcaacaagccgatgcaccgtttggccggggcccgcgggcggctttaaccgctgcggcagaactgggaaaggcttatgggtttaaaacggggattgttaattcggcaatggcgtatattcagtggggtgacgatgaccagcattatatcggcatcgtcggtcacttggatgtggtaccagcgggcgaaacggattggcattttccaccatacgacctttcggaaaaggctggccgcttatatgggcggggaattctcgataacaaaggcccaagcattgcctgtttatttgcgatgaagctgctcaaggatgccggttttcagcctaagcggacgattcggttgattttaggctcggatgaagaaagcggttcggcggatgtccctttgtatctcgccaaggaagccccgcctgagtttggtttcacgccagactgcaaatttccggttgtatatggcgaacgcggcattgtgaattttaacctgcgcacgcccatcaccgatgattctctcgacaaagtagccaccatcaccggcgaccaagcaagcgatcatgtgcctgaccacctgcaagcaacgatcaatgacaagcgctatactgccagtggcatccgcgcgcccagcaatgccccagagttaggtaaaaatgcgatcacaaccttagccaaggaattgctagacgaacacgcgatccacggacagtttgccaactattgccaatggttggtgcaaacgctggcgaaccagcaccacggcgaagggctagggatggattttgccgatgccgcaagtggccgattgattgtgacaccttatcagctgcaaaaaatcggcgcggtcatcagtctgcgagtggcggtccgctatcctgtgacttatcaagagcatgacgtcacccgcgcgctgactgcagccgtttttccccgcacccaaataaccgtgattcgcagcatgccggggatcctgcatgacaaaaacgatccgcggctggcagcattgacgcaagcctatgaacaggtgacggggcgagagggtcaaccggtcaccacaactggggcgacttatgcccgtaaaatgccaaatattgtggcattcgggccctcttttcccggtcaaaaaggcattgcgcataaggcggacgagtggatggatgagcacgatctcaagttaaatatgatgattgatatgaatgcgatgattcggttaggagcgatggataaatgaacgaaacagcttggggcgtgattgccacttggcgcatggcccacgatggcgtgaagaaagccagccagctgctgcaagcaaacggcacagccggggatgcagtggaggcattgatcaaaaccgttgaagcatacccttattacaaatcggtcgggtatggcggtttgcctaatgaaaatggcgaagttgaaatggatgcggccttcatggatggcgacactttggcccaaggcgcagttgctggcatccatgaagtactccatgcggtttcggtcgcccgcgcgctcagtcatgatcattacaacagcttccttgtcggccaaggtgccacccagtacgcccagttaaatggcttcgaaatgcgaaatatgttaacagaccgagccaaaaaacgttgggaaaagcgccgggcagaacttgctgacgccaaaatcaaaccttacgatggccatgacacggtgggcgctattacgctggcaccaacaggatcgatggccgcggcaacctcaacatcaggcttatttatgaaacgcccgggtcgagttggcgattcgccactgtccggatccggtttttatgttgacagtgacatcgggggcgccgcggcaaccgggttaggcgaagatatcatgaaaggctgtctatcctacgaaatcgtacgccgcatgggtgaaggccgtacgccgcaagaagcttgcgatgaagcggtttatccgtttattgaaaagttaaagcgccgttatggtaaagccggtgaattttcgctcatcgctttagaccgcgccggcaattggggagtcgcaacgaatgtggaatttaccttcagcgtcgccactgccagccagaaaccggtgatcctcatggcaaatcccggtccgaatcaaacgaccacgattacgccagtcacccaagcatggctggatgcgtatgaaaaacgaatcaaggcgccgattaagtagcaatcgtgcactgtggaagaaaggattaccatgaagcagtacttggcaattgacgtcggcggcacctcgaccaaatatgcgttagtatcggagcaaggcgagctcgcggagaaacataaacagccgaccgcgcgcaacagtcgggctgaatttatggcggcaatgacgatgctgatccaccgatatcaaggacaaattgctggcgtcgggttggccttgccgggtgtcgtcaatcagcagcaaggcatcgtcaaaacctgtgccgctctcccgtttctagaaacaatgccactggctgcgcgacttaaggatgctgctcatttaaacacaccagtcgtgattgaaaatgacggcaatgctgctgccctagccgaacattggcaaggcaagctcgccggcaccatcaacagcgctatgatcgtgctcgggactggggtaggagccgcactgtttttaaacgggacactctataccggcagccatgatgtcagcggtgagccgagtttcatgattaccaacggcctcaaccccatcacccgtgcgcaaaccgccgccggactctcagcagtcaaaaccgtcaacgccatggctgctgcccaacacattcgcggccacaatcttggcccacgcgtctttaaaaccctcaagcctgacacacccgccgctgcaatcctagccaccttcactcaaggcgtggcggcgatgatctacaacatacaaaccgttctagacctggaaaagatcgtcatcggcggcgggattagcgttcaatcacgtgtcatcgacgaaatccgggcacgggttgctacctatctgcaagtaacgccacttgcagcgaggacgattaagcttccggagattgtggcagctaagtatcgcaacgatgcgaatttagttggggcggtggtgccgatggtggcgcgttaagaagtgtaacgcggtgatgatgcaaaaatggtttgtatgtaaaaaatcaatcgttttattttcatttcacctaatcctggaaggctcgcaaagcaaaaaaacaggcattataccagcccaaaacactggtacaatgcctgttttaatttacagataaaacacatcccaaccgaatctacgcctcaatgcgctgccattcactcatggcgcttgcttaaaatgctcaacagtaagctgaaatccatgacgcttgagtacggcagcataatcggaaggcaaaggttgatcaaagcggaagtggatgagtgacttgatttcaccgttgtctgcccggacgccgaaaatatgggcatcgccgggctcgactggcagacagtcaataacggtttgctccaggtcaccgcgttgtttggcttgaatcagcgccgttaagagccgatcaagatttgtaatggtgacgggctgcatactctcaactccttcctttcctattcaaccttaaccaagattgattggcttagacgcgctttttacgtgatacgaatcctgccaagccgagcatgcttaggattgcaaggccaagaacagccagtggactttgcgcttcaccagcttgcggcatggttttggctgcggcggtttgtttggtgttcttgccagtttcagcagtagtaccggttttgtcttggcccttggtggtgtttgtcaaatcaacgaattttggtgtcggattggttttgccttgctcatccgttttcggagtagtggtaggccctttaggattttccgtgccggtttgatcgcccgtgcctggttttggcgtcggcgttggcgtcgtcggtgtttctggcgtcgttggcgttgttgccttggtcttaattacgtggaagaccttggtgactttattgccgaccatatcaaccgcggtgatggtgaagtaattgtcgccgtctgctaattgataggtttgcgtgaaggcggccgcaccgtatgggttggaagtcgttgacagcggatcgaggtggttgttgaacccagctagattcttctggtgcacaatgttatcgccgtttgtgtagaggcggtagccattgatgttgtcgttaacggttccggaaacggtgaaggtgtcgctggttgtggtgatttcgtaattgcctttgtcatcaacctgcagcgtatcagcttgcggcatattcagtgttgggaaaatggtgtcgaggtagatttgaagctcgccatacgcggtttgcgtcgtttttgagccatcagtggcaggggaagtcaatcgatagccgattgcttgttgctctgcggctttgaatggcacggtaaagctgaatttcccgtctgcaccaatcgtgaccgtcttcgcaggctcggtagcactggtgacggttaacgtcttgccggctggctgatcaacatgaccggtgatggttaattgacctgttttggcattgtagatgtcagccactttatcggcgccgaccaaggtgaaggaattgtcgttgaatttatcaaacgtcagcccttccgttggttgtgcgtgggtggtgatttgagaaaaggcacgaccacccaataccggagcgccactggttgttttcacattagccgcggctttggcgttatcctgcagcggtactgcaacgtgaggattttcttggctgaagtggccatagcctgagctgccgtcatcaaggaagacgaccatttcatctccgttggcgcgaccggcttgttcataggtgccaaaatccgctgtcggtgcgaggacggtgccgacaaagtcaccatatggagcggatgcggttaagttaaaggtgacattgccggttttagtatcgactttaccggagaagactttaccactcatggcatcggtcgcgtatacgatccaatcaacgccagctggaacctgagcataggccgtaaagctggtttggtcggacaccgcttgaacgaagccatctgtacgccagtggttgtatggaccatcgccaactttccagctgaactgcggtgccacattggcggttgttgctgttggcgttgttgcttggtgggtaccggtgacggcctgcagcgttttgctggttttattaccggcaacatcggttagcgtcagagttaaactgccatcgctgctttcaagtgcggctttttgggctgcggtgaggtcaaagctcaaggtgccatcgttattctggccgttgttattcaaactgacgccataagctttgccaccgatcttcaacgcgatgtcactgaacttggtgaagcctgcaccttgatcgttgtagttaacggtgacgcgaccgttttgatagctcaggcctgtcagggtcggggcaacggtatcaacggtgaccggcaagtcaaagtcctgattttgctgggcgccggcgttatattgttcggttaccagccgataagtgtatttgccgtctggtgcagtcacatatttgccagttgcttggtcataaaccttgccgtcccaagtgaaggcatttggatcgagacgcatatccgtgctcagtcctaagtcagagttgtagctattcccattttgcagataggacttggttgtgttgttttccttatccaacacgcgaaccacatggccttgtgcatctagaatctggatggtaacggacttgaggttctgcttggaaaatacatatggatagacggtgtcgctggcaccatcgccattgggtgaaaatgaaacctttttgttgtcgacgtaggttggaaccagtgtccaagtatacttgccggttgtatctgtgttcacgaggctgctgagtgacgctgagtcggtgacccctagtggtgtgttggcgccatcaaccaaatagccgccattaaaaatggactcgccactgttagcagacgcatcaaccacctgttctgtggtgagatcaaaggtgcatcttcaaggtaagcatggatatcttcacctttgtcgatgaagtatttatccggcacaccattgacgatgttgtcctgagtcggttcgttcaaatacgggaagtcttttggcatgatctcgttaaagatcgccttgccgacactcgtcaccataatcttttgtttctgctcatcagtaaacggtttgtccgtaaaggagttcgccgcaatcccgacacggctgtgcagatgaacatagccattttgcaacgccatcaacacttcattggtatccttgaagatcatgccttcgccttcgcggcccttctgctccatggtcaggtagtagttacctaacacaacgtcttgagaaggggtaacgattggcttgccgtctttaggtgccaaaatgtggtgagctgccagcatcagcatgcgcgcttctgccattgcttcatcagatagcggtacgtgaatcgccatctggtcaccatcaaagtcagcgttataagcttcgcagactagtgggtgcaagcgaatggacttaccatcaaccaagacaggttcaaatgcctgaatacccagtcgatgcaaagtaggcgcacggttcaaaaggactggccgttccttaatcacatcttcgaggacatcccagacatcatcatcttggcgatcaatcttccggcgagcatttttaatattgcttgccatatcgcgcttaaccagttcgcgcatgacaaatggcttaaagagttccaaggccatttcacgcggaacaccacactgataaaacttcaaccatgggccaacatcaataaccgaacggccagagtaatcgacacgcttacctaacaggttttgacggaatcggccttgcttccctttcaacatgtgggacaaggacttaagcgggcggttaccaggtccggtaaccgggcgtccgcgccgaccgttatcgatcaaggcatcgaccgcttcctgcagcatgcgcttttcgttttgcacgataatacttggtgcattgagatcaagcaaacgcttcagacggttgttacggttgatgacccggcgatacaagtcgtttagatcagaggtcgcaaaccggccgccttcaagctgaaccattggccgcaaatccggtggaataacaggaatcgtatccataaccatccatgccggatcattaccagactccttgaacgcatccaaaatgtccagacggcgaatcgcacgggtccgtttttgaccctgagctgatttcaggtcttcttttaattcagcaacttctttttcgagatcgacatcctgcaacaattccttgatggcttcagcacccatcttggcattgaaggtctgtccatattcttcccgcttttcgcgatattcgcgttcggttagcagctgctttttctccattggcgtatcgcctggatcaatcacaacataggaagcaaaatagatgatttcttcaagtgaacgcggcgacatgtcgagtaccagacccatccggctaggaattcccttgaagtaccagatgtgcgtcaccggtgcagctaattcaatatgacccatccgttcgcgccgaaccttggaccgggtgacttcaacgccgcagcgatcacaaacgattcccttatagcgaattcgcttgtacttaccacaggcacattcccagtctttggtcggtccgaagatacgttcatcgaataagccgtcccgctcaggctttagggtccgatagttgatcgtttcgggctttttgacttccccataagaccagctgcggatcttgtccggcgaggctaagccgatttgcatactttcaaacttattgacatcaatcaaagggctaacctcctatttcttatcgtcggtactattgtcggcagactgaccgtcacttgcttgggttgcggcttcgtgtgccttcttttcttcttgctgagctgcgaacttcgctaatgcatcgacagaaacaacatcgtcttcgtcatcgtccatgtcgcgcaattcgatttcctgcttatcagcacctagaaccttcatatcaagtcccagcgcttgcaattccttgaccagcacacggaatgattccggtacgccaggctttggaattggatcgcccttaacgatggcttcgtaggtcttaactcggccaacaacgtcatcggacttataagtcaagatttcctgtaaggtatacgctgcaccataagcttcaagggcccaacttccatttcaccaaaccgctggccaccaaactgagctttaccaccaagaggctgttgggtgactaagctgtaaggtccaattgaacgcgcatggatcttatcatcaaccatgtgagatagcttcatgtaatacatgacaccgacagatacccggttttcaaatggttccccggtacggccatcatacaagactgacttcccatcagatggcatgccggcttctttaacggttgcccacaagtctttatcgttggcaccgtcaaagactggcgttgcaacatgaatgcctaagttacgagcagccatgcccagatgcaattccagcacctgcccgatgttcatacgacttggcacacccattggcgacaagcaaatatcgactggggtaccatctggcaagtatggcatgtcttcttcaggcacaacgacggaaaaccgtccctttgttcccatgacgaccagccatcttgtcaccaacttgaattttccgcttctgcgtgatgtaaacccgtaccatcatgttgacgccaggagataattcatccccagcttcacgggtgaagattttgacgtcctgaataatgccgccgccaccatgcggaacccgcaacgatgtgtcgcgaacttcacgtgctttttcaccaaaaattgcgtgcagcagccgttcttcagcagataattccgtgactcccttaggcgttactttaccaaccagaatgtcaccatcccgaacttcagcaccgacacgaacaaccccgaattcatcgagatccttgagggcttcttcaccaacgtttggaatctcacgcgtgacttcttcaggtccaagtttggtatcacgtgcttctgattcatattcttcaatatggattgacgtgtaaacatcatctttaaccaaccgttcggacagcacaatcgcatcttcgtagttgtacatgttccatgtcatgaaggcaatgattgggttttgccccaatgccaattcaccattttgcatggctggtccatcagcaatgatttcatcgacatcgacatggtcaccgatcgtaacaatcggacgttggttgtagttcttgccggcgttactacgcttgaatttcatcaatttgtaagtgtccaaggcgccgtcttcacgacgtacccggatttgcttagcatcgacatattcaaccgtaccggcattgttagccaaaaccgcggttcctgagtcatgggcggctttgtattccatcccggtcccgacaagcggggcatgcggattgatcaaaggtaccgcctgacgctgcatgttagcacccatcaacgcacggttagagtcgtcgttttccaagaatggaatgcaggcagttgcgactgcgacaacctgcttaggcgaaacgtccatgtaatcgactttgtctggtgaaatttcaatgttgttatctttatgccgggccaaaaccgtgtcatcaacgaaagatccatcatcgtttagtggcgagtttgcctgcgcaacaatgtagttatcttcttcgtcagctgtcaggtaatcgatcttgtcggtaaccttatgcgtatcccatgaaacccgtcgatatggcgtttcaatgaagccgtatgggttaacgaccgcgtatgaagccaagctgttaatcagcccgatgttcgggccttcgggggtttcaatcggacacatccggccataatgggtgtaatgaacatctcgaacttcataacccgcacgatcacgagtcaagccaccaggtccaagggcagacagacgccgtttatgggttaattcgcccaacggattggtctgatccatgaactgtgacagctgggaactgccaaagaattcgcacaggttcgcgatgctttggaagaaaaagggtataaattcgtccaaaacgaattgacgatggtaccacaaaatctgaccccgattcctaaagataaagtcgaacaattccaagccatgatcgatcagctagaagacgatgatgatgtgcaggaagtctacacagccggcgactggccagacgattaatgagttgaataaatgagtgaagaggctgggctatcattcccagtttcaaactaaaggcgtactatttctcaaatttagcgagaaatggtacgcctttttgattctttacattagtatcaatggcatttaacgattttagcaccaaggcggagtaatctctggctagatggatggcgttgcatagctagggcggaaacagcgcggctaagggacagagtgtgagcatcttgagacataatggccgtatttttaatcaccgtgatcaatgtccttatgtgcaaacgatgacatccgcaaaagcgtgacgggtaaactttttaggttaatgacaaactcgtcctcaactgcgaattcttttaatgcaggaggaaagagtatgcagtcagtgaaaacgttattgaccaacgcattagccaaaggagccagcgatatttactatttgccaaatccgcacggttatctgattcggcttcggttaccgacagggttagtgactttagggcaactgggaacgcggataggtcagcaagagattaattatctgaaattcatggctgggatgaatgttgcagagcatcgccgtgtccagttaggcgcattttatcatccggactctgatgtttttctgcgtttaagctcggtggcagattttcggggccgcgaatcattggtggtgcgactgatcagtggtattccagatgcgcagggtgcacgtcagttgttggatcggttaatgagtattttgacgcaacgccgaggcatgttgacattagctggcccaaccggatcgggtaaaacaacgttactgtaccagcttgcaactcgcttggccgcctcgaaaatggtgctgtctatcgaggatcctgtcgaaattaatcagcctcagtttctgcaacttcaggttaacccagaagcggaaatgagttatccgcagttgttaaaggccgctttacgtcatcgcccggatgtattgctgattggtgaaatccgcgatcggcaaaccgcccagagcgcctgtgaagctgccattagcggacatattgtgcttgcgaccgtacacgcacgttcggccaacgacaccccactgagactgactagctgtggcttacctgccgaattggtttctgccgcct

SEQ ID NO: 98 - DNA, 1753 bp, Lactobacilllus rhamnosus
agtccaaccgctgcgatgggtgtcggctatggattaacgtcagttttaggacttttcctcaatgatacctgggtctttaaggttaaagatcaccgcgaccttaaaagtgtggcaccacgatactatttttcgtatggtctcacctttatcatgagcctgatactcacaagcttctggaatgatgcattgaatttaccaaaaccattagcaccgatgtttgcacttatgattaccgtcccaacgaacttccttttaagtaagttctgggtatttcgagaaaagggagttacggcacatgaaaaaaattaaacagtggacccttgattggtggctcattggcattctcgttctggctgcgtttctttacagctggaatatctgggaagcaggaaacgctaatgattattacacggctgctatcaccagtatgatccaaagttggcacaatttctggtacggcgcatttgatcctgctggctttatcaccgttgacaaaccaccggtagcgctttggttcatggccatttccgccaaaattttcggcgttcacggctggtcagttgttttaccctcaattttgtttggcgtcggcagcgtggcgctaatctataacatgatcaaaccccgctttaatgtttgggccgcccgcttagctgcattggcactcaccttaacgcctatcgttgtcgcggattcccgaacaaataacatggacgccacactacagttctttctgctactcgccagctggtgcctgatgaaagcaatcaccaaccgcaagccttggctggtcatcatgagctttgctttgatcggggtttcgttcaacattaaaatgctccaagcgttcatgattttgccagccttattactctttttctggcttgcatcaaagcagcagttatggcgccgactggctacactggggattgcattagccgcgatggctgtcatgacacttgcctggccactacaggtggactcaaccgccgccagccagcggccctatgtcggcagttcccaaacgaattcagaaatggagctggcttttggctataacggtactgaacgattattgggccaaacaaccggtaccgggtgcggccttccccggtatgggcaacagcaagaccaaagcaactggtgaaatgaacccgacatccggggcgaccaaaggcaataatagcaaaaccggcacggcaccgactggcactaaaggaaatccaccaaccggcacaaagggcacaaagggcacaaccggtacgccacctggcggaaatggtggtggtcgcccaggtaatggtcaaggtcagggcggcacgccgccagctggaaccaacggcaaacaacctactgtgaaaaccaaatccggcacatctacaaataacgcacctgcaaactttgcagagggcaactttaaaggcggccgtggtactggtggtggtgcagctggcggtcgcggcggtggtgcagctggcggtcgcggtggtggtgccttttcaattgggaatgccgggccactgcgcctgctgcaatctgatcttggcaaccggtggccctggcatggttaagtcagcttattcatccggcaaaccggccttgggtgttggcgcagggaatgcaccggcatacatcgaagcaagtgccaatattaagcaagccgttaatgatttggtcttgtccaagagttttgatcccggtatgatccactagtgtcgactgcaagcgcctaccaaagtttctatcgcccggc

SEQ ID NO: 99 - DNA, 6249 bp, Lactobacilllus rhamnosus
tcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttactttgccacagcagccaaaatcgtcttaatatctgcaaacactttatcgatgtcttgatcaccattaacagtgtggagcaaacccttcttttgatagaagtctaataatggcgtattcatctcgatgtttactttaagacggtttttaacggtttccggcttatcatcttcacgttggaagaattcgtggccgccacagcgatcacatgtgccggcaacctttggcgggttgtagattttgtgataagttgcaccacatgtcttacagataaaccgaccagacaagcggtcaactaactttgcaggcgcaacatcaatattgataacagcatctaacggcttcttaagatcagctgtgatcgtttcgagtgcctctgcttgttggatggtgcgcggaaagccgtcaagcatgtagcccgcatcggtatcggactcagcaaggcgttccttgacaatgccattggtaaccgagtcgggtaccagttgacctttatcaataaagccctttgcttccttacctaatgctgtgccagcagccatcgcggctcggaacatatctccggtggaaatatgtgctatcggataagtatcctcaatccgttctgcctgcgtgcctttccctgcaccgggaagtcccattaaaatgagattcacgttgcatcctcctctaattgtacgcgctggcatgtatttaaaactgctgtgaacagcttctaaacgatttaacgctgaaacttgccagtttgtacgctgcttttaacgcgtcaaccattgaaaatggctgacttctgatatcgtttacttcttatcgttcttaaccaaatcaccgcgaataaatccgacgtactcacgcttcatgagtaagccgtccaattggcgaaccaattcaatagcggtcatgacaacaatcaacaggctcgtaccaccaagtccgattgattgcggcaacccccaaatgttggcagccagttgtggcagtaaggcaaccaaaccaaggaacaaagcacccactgttgataagcgcatgagtagccgtgagatataattctcggtttccttacccggccaaacaccgggaatatagctgccttgtttggttaagttttctgcgaccttctcgggattaacctgaacgaacgcatagaagaacgtgaacagaataatcaaaagcgtatagatcgcagttccggctggcttttgcatattgaagacattggtcatgacttgataccatccgtcagtcccatgattcttctgaaaagccattaaaattgtttgcggcgtcacaataaaggaactcgcaaaaataaccgggataacaccggcaacgttaactttaagcggtaggtaactgttactgcccgcgctggtaacgcgccgagtgtactgaattggaattttgtaattagcttgctgcacccaggtgacaaatgtgataaccaggatcacgatgactgccaaagctgctaaaaacgcaattcctttccagatttcagaaccagagtatacctgaacgttatcccgatataactcctggagacctgaaggcaggcgtgccacaatcccggagaagatcaacagcgaaaccccattaccaaggcctttatcagtgatctgttcacccatccacgtcagcaacattgtgccgcctgtaaggatgataccgattgtgatataggtactaacggacggatttttaaccaagcccatcgaacttaacgtttgaaagccggccgtaatcccaattgcctgaaagaacccaaaagcgatagtcagataacgagtaacttgattcagcttacgccgaccgacttccccttgcttgctccactcgacaaatttcggaacgatatccatctgcagcagctgaaccacaatttgggccgtaatatacggcgaaacccccatcgaaaagatggagtattgtgccaatccgccaccactgacagtatccagcagtgagatcaagcctgtcgagccgattgactgcagcgccttggcattaacaccgggaactgcaatcagtgtacctaatcgatagaccaataaaaccgctaaagtgaagaggatcttgttacggatgtctttgaccttgagcgcgttttttagggtcctcagcattagatcacctcaatcgaaccgccagctgcttcaacggcagcttttgctgcggttgaagcttttgcaaccttaatggtcaattttttctcaagtttaccgtctgccagcaacttaacaccgttcttttcgttcttaacaatcccggcatcgatcaaggcagctggtgtaacttcagcaccgttatcgaagcgattaagatcggaaaggttaacgattgcatattctttgcggttaatgttgttgaaaccgcgctttggcatccggcggaataatggcatctggccaccttcgaagccaagacgtgtcttgccgccttgtcgtgccaattgaccttttgtccctttaccagctgtcttaccttgaccgctagaagtaccacggcccagacgcttgcgggcatgacgggagccgacactcggctttaattcgtgcaattgcatactcttgggcacctccttgtcgaaataatgtattaatctttgatttcttcaaccgaaaccaagtgtgaaatctggaaaatcgcaccacgagtggctgcgttgtctggtttaatcaccgagctgttcacccgatttaagcctaattccttcacaattttacgttgcttaggaagacggtgggcagcactacgggtcaaagtaatcttcaattgagccatgtgtttacctcctagtcttcaagcgatgacgcagaaacgccgcgtaattcagcaacttgttcgcgggtgcgcaactgtgtaagtccatccattgttgcccgaatcatattgattggcgtgttacggccaagggatttgctggtgatatcagcaattccggcaagttccataacggaacggatagcgccaccagcagcaaccccagaaccttcttcagcaggcttcagcaaaacttcaccagcgccgaagtggccgattacttcatgaggaatcgtggtgccgacaattggcacttcaatgaggctcttcttagctgcgtcaacagctttacggattgcttcaggtacttcttgggctttgccggttgcgaagccgacgtgaccgttcttatcgccaacgattgcaattgctgcaaaccgtagacggcgaccacctttaacaacctttgtaacccggttgatggcaacgacctggtcttctaagtccaattggtttggatcgataaatgatgccatgtgttggttatcctccttttttctagaattcgaggccattttcacgtgctgcttcagctaaagcggcaacgcgaccatggtacagataaccaccacggtcaaagaccacaactttatgaccatctgcaactgcgcgcttggcgatcaatgcgccaacctgagcagccgcgtcagtcttgttttcaggatctttaatgtccttatcaagagtggaggcacttgctagcgtcacacccgctacgtcatcaattaattgcgcgtagatgtttttattggaacggaaaacgttcaagcgtgggcgctcgctcgtaccagaaatcttgcctcgtacgcgggcgtgacgccgttgccgagtcttattcttatctggctttgaaatcacaatgttcacctcttgttaaatttgttgaaggttacgactacttaccagtcttaccttccttacgacggacatgttcgtcaacataacgaatacctttacccttataaggttcaggtgcacggacggaacgaacaacggctgcgaattgaccaacaacctgttttgagatcccactgatgatgatctgagtggtgcttgggacttcaacagtaacaccttttggcgcgggcatttcaactggatgtgagttaccgacgttcaaaacaagtttttcgccttgcttctgcgcacggtatccaacaccaaccagcttcatttctttcttatagccttcggtaaccccaacgaccatgttgtttaagttggcacgcatcgtaccatggatggccttgtaagaatcatcgggacgggtgaaattaatttcgtcgccttcctgatgtaattcgatttccggggcaaaatgacgggtcaattcgcctttagggcccttaaccgtaatattgtcaccatctttggtaacagtaacaccggctgggactttgatgactttataaccaatacgactcacttatcggcacctcctttttgatgttatgaattaccaaacgtaagcgagtacttcgccgccaacgtttttggcacgagcttccttatcggtgataacaccttcggaagttgagataattgcaatccctaaaccgtttaaaaccttaggaacagcatcactcttaacgtatgagcgcaaacccggtttggaaatccgcttcaagccggaaataacccgttcattgttcttaccatacttcaagaaaatgcggatcccaccgtgcttgtcatcatcgataacttcgtagtcacggatgaacccttcacgtttaagaatctcagaaatgtctttcttcatctttgatgcaggtacgaccaaggattcgtgacgcaccatattagcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgatatacggaatgcggacggccacaccgttggcaccgcgtatattcctggactgcaaattttgcaggccgtttgtttttagcgatcattgacttcttagccaagtagcggacctcccttatttggcgaatggcatcccgacttgcgtgagcaactcgagtgcctcttcatcagtatttgccgttgtaacaatcacaacatccaacccacgaacccgattaaccttatcgtaatcgatttctgggaagatcagttgttctctaacacccaatgtatagttcccgcggccatcgaaggacttaggggaaataccgtggaagtcacgaacacgcggcagggaaacattgatcagcttatctaagaaatcatacatgcgttcgccgcgcaatgttaccttggcgccgattggcataccttcacgtaagcggaaaccggcaatactcttcttggccttggtgatcagcggatgctggccagagattagcgtcaattcttctaccgcttcatccaataacttagcattctgagttgcatcaccaacacccatgttcaaaacgatcttttcaatcttaggtgcctgcatggtgctcttatagttgaacttgcttaccaatgcaggggcgatttctttgctataacgttcttcaagacgattctccatgaaaaagtttgtcctccttccctattatttatcgattgcggtgccagacttcttagcaatccgcactttattgccatctttaacttcagaaccgatgcgagtcggcttgttggtttcaggatcccgcgctttgccattaaaaccaaaaagaatgggacgtatacgtttgcagcgaaagatcctaagcgggttttacgtgccattcgggtgcacattcccgccgagcgaattgttaagtcgttaactttctggcaagtcgtaaagcgcgcctttacacgcaagaagtagcaacgatcccaggcgtataagacaaaaagacagctcacaggacttcttttttgaaggctgtgagctgtttttttatggagcggtttattttcactgctggaaatcagcaagcgccggttactttgttttgaagtttttgaacaactcattgatcgattcgtattctgcatcccgtagatcgacatcgagcgctttagcattgctggcagcttgttctggcaggcgggcaccggggatgacaacggcaatgtcggggttcttcatgtaccaagcgagcataatctgcgcaatcgttgcttgatgtgcatccgcaatgccgtcaacttcgcgaagtgcggctaaaatttcttt

SEQ ID NO: 100 - DNA, 12023 bp, Lactobacilllus rhamnosus
gcgatttttgtttaatttggctggattattgaattgctgaatcgcattaatcgttaaaatctgcaggtcgtatttttgctttaacgtctgaaattctgcaacctgcatgccatcaatgacagtctctgagccatcagaagtggtcatatcattgcgtaactcgacttgatgaatgccagcagcttcggctaattgaaaaaagttttccagtggccgcttctgagcaatttttcgattcaaagccatttgtgtcagttctatccccatcacgactcccccacttctcttcgcctacccaaacaatctgcgacttagtgtgatcgcaattatggcgtcaactaaagcagttgcccgccaccgatacagacgcctcggtgcagcaacctgcacatatacgaactttgagcaccatgaccaaacgcctctatgctcccgtttctgaccacaccgactcgcgttcacaaaaataccttggtcgattcctctggcaaagttccagaagcggccaaggcatcctgctttacttgatattctctttataaactgccatccaaaaattgggctttgccttgaccaaaactccagccttgatcatgattaaacgaaacattgaccatgagatcgttcttatccactaatcccgcttcggataagcgccttgccaaactttcataaaactgctctaattggtgaaccgtacgaacgcgactcactaacgaaatcacaaccacctgatccgttcgtggtatgcccaacccggtatcctcaaccaccatttcatatggctcatgttggtggacaatttgataacgatcacgctcgggtacctcaaacgctgcaaccatcacttcatgggtgatttgcaaaatagctttaatagtctcgggtgaccgcccttttaacatgtcaaatcgaactaatggcatcgttccccctcctcatacgcagcggtaactgacaatcagtattcttattagactatgaccgacatgagccaattcaatcgccatgtgaccggacaattattcaaaggtcactgagcgtttactctttccaagaatatgaaatgccttcattttggtttcaactaattgcgcaatcgcctttttgcctgccaaaagaatcggttgcggatcatgaccggaacgtttggcttgcaccgcttttgtgatagctgcagtccacaccgtgttcacttctgtattgatattgatcttagccgttccggtttggatcgcctgttgaatctgatcatcaggaatgccagatgcaccatgcaaaacgagtggtaacttggtagcggcggcaatagcagccatccgttcaaagttcagattcggacggcccacataatcgccatgaaccgatcccaatgctgcagctagggcatcgatcccggttgcggccattttaacggcatcggtgacactagcataacggatgccattgattaagccattttcattgccaccgacactgccgacttctgcttcaaccgaaacatgatgctggtgcgcataacgaactacttcgtcggttaaagccacgttttcttcaatgggcagcttagagccatcaaacataacagaggtatatcccgcatcaatagcctgataaacatgttcaactgacaagccgtggtccagatgcaatacgaccggtgcggtgatgtgcaatgcctgcaccataaagcgtacatagccggcaatgaaatcgaatccgccaagaaaatcaataattcgatcagaggtagcaacaataatcggcgttccggttttctgcgcaactttaagatacgtttccaaccaatcggcaccattaatattaaagtgaccgattgctgcgtgatctgccagtgcagcttgaatcagttttgttgccggtatcaacgccataaaaccatatcccttctcaaacagaacccttaaactgcttggggaatcgtcatgatcgtatctagataatgcttagcctttagcgcatattcaaatggatttgcttttgctggatcttgttcagcttcaaccacaatccagccgtcatagtgttgcttttgaatggcttcccaaatcggcttgaagtcaatcatgccatcgccaggcacggtaaacatgccatttttaacgccttgaaggaagcttaagtggtcagtacgttcttgctgggcttgttcaggacgaacatccttgaagtgaatatgcttaatccgatcatagtagcgatcaaaaattgttaatgggtcctcaccggataacaccaaatgtccggtatcaaacaaaagagacactttatccggatctgtcatggccattaatttatcaatttctgccgttgtttgaaccccggtacccatatgatgatggtaaacaatctgcatcccgacttcatgggcgcgatcccccaaccgttccaaaccagtggccaagcgttgccactcttcatcggtaaaatgcggtttatcatcaaagaccgacttatccaacatgccttgaacactatggccttgttctgctaccacgattaccttggcccccatggcgtgtagaaaatcacgatgcttgataaacgctgcttcggtttcttcatagggcttggtcgttaaaaaggcgctaaaccaggcactagcaattttcaggtgtcgcagatccaagtaatgctttaaaaccactggatctttaggatatttattcccgacttccgttccttgataccctgccagcgccatctcatcaatggcctgttcgaacgtcacttctttgcccaagtcgggcatgtcatcattcgtccagccaatcggggcaattcctaatgcaatcgtcactttaagcacctacctttttatcaacatcggtaaccttgacaatatcgttcttttcgtacgcgcgttgcagtgccagcgcggctttggtccctcgaaggccatcttccgccgtaatgccgactgtctcaccagtcaaaatactgtcgacaaaagcctgttcttcacttaagaatgcctgggcaaaacgctctgggaagttttgtgaggttggccgaatgatgccttcttcattcatgaccgtcaccagattcttctcaggcacttgcgcaacccgcagcatgcccttggttccgataatctccgtttcgacatgatagccatgagcagcgttgcgtccggctactaagatcgccatcgtcttatcctcaagttgcatcagtgcagcacctgtctcaagctcgcctgcctgatccaaaaccggataggcgcgatttaagccgatagcccagactttatcaatttccttaccggtcaaccagcgaataacgtcaatatcatgaatcgacatatccaggaacaagccaccgctattggctgaagttgcgaacttgacaaaactttccatcccggctgcagggtcaatactgtaactgcgaataagcgtgatatcaccaattttgcctgcatcaactaattgcttggcataaacatatgaatcatcaaagcgccgcataaatccaagttggaattttaactccgggtgatcggcaatcactgcctgagtgtgtttaatggcatccagatctaacccaatcggcttttcactgaaaacatgcttgcctgcttgcatggcactttctatttgcggcaaatgaaacccagacggtgacacgataaagacagcgtcaatatcggcatgttgaaccatgtcatcaaagtcttcataggtttcttcaactccgagttcttgacgtgcccaggctaactcctccggtaccacactcgttgccgcttgcaacttagcatgtggaatcttcgtggctagattggttgcatggattttaccaagtcgtcctaaccccacaatgccaattttaacttccctttgaaccatcgcgttttccccctcttttttacattgcttgactagatggctaagcctttaccggttgattcgtttgataaaatgttggcgtctcggcaacattgatcaaaaccggttcttgatccttttgcgaacgaatcgcggcctcggccgtcaccgctgcaacatacccatcccaagcactcgggccgaccggtgactgatccttagccacgtgatcgataaattcctgaacttcggtgttgtacgcttgcaagaagcggtttacccaacttgtttccatagcggtttgctgagttgcttgggtgcgaacgattggctcgaatccgtaatccggtagctttaattctccggtttcgccgacaacttcgagtttgacttcataaccgtactgcgccgtcacatgaaccaacacttgaatgaccgttccttttttggtggtcaatgtggctaattgcggatcccgcaacccttcattggtcacctgacttgactggcgcggataggtgatttgaatcgatgcataatcatcatcaagtaaccaatgcatttcatcgatttcatgaatcaatgtatccgtaatggccatttcattggaataattggccgcaacattaggattaatatgactggcgcgcacaaccaacggcgttccgatgatgcccgaatccagcttagtcttcaaggcatggataccctcatcataccggcgcataaagcctacttgaatgacttttcgcggtttgcctatttccttatccacgatccgtttagctccctcaagggtcgttgccaacggtttttcggtgaaaatgaatttatcggtgtctaaggctttgagaatagtcgcctcatgtgcaccgccaaaactaacaacaaaaacggcatcaatgtccggatcctttaacaaactcgtgtcatccggataaacctttgcgttaagcttaaagtcccgaacagcggcttgggcagcttcttgatcaatatccgtgacggcaatgacttcagctccggttaaaacattggttagccgatcaatgtgtgcacgtcccattgcgcccgtaccgataaccccaactttgacaaccatgtcaatcgctcctttgtattgttgttttcctcagtatttaaatgcctgatcaatacctgtctgaatgtcttgatacgctttttggacgtttggattgtcggatacctcggaaacccccactcgccaccaactttggccgtatccttgtgtcatcgttttaggcagcactttaatatcaattaatgtcgaaactgtttgcttcttggcatcctccaaggcagcgactaaactgtcacgatcattgacgtgataagttttagccccatatccttccgcaattttggcaaaatcgattgttaaaatatcatggtcggcagttctaaattcggttcgatagctgttgctgccttgagccatttgtaagttattgatggaagcaaatccggaattatcaaagactaaaatgttgatcttcttatgatattgcagcgcggtgacaagttctgaatgcaacatgatgaagctgccgtcaccaaccaaggcataactttctttatccggttgtgccaacttaatccccaatgctgccggaacctcgtaacccatcatggaatacccatattccatgtgataggtattgggtacaactggatcccagattcgttgaacatcccctggcaacgatcccgctgcagcaacaataatgctatccggcgcaatcgtgtcattcacagcaataaccgcttccgtctgagtgaaatgggtttgtaacttctcggcatactcagctaatgttgccgcactgaattgacccttaacctcaggcgtataatctggcgcatcatagtttgtatgggccaaacgctgccgttcctgttgccaagcagctttgaggtctgcgaggttggtaaagtcactttgatatccggacaattcactagtcagttgggtcagtgtatcccggacatctgccacaatcggaaagccgtcaaacttatacgactgcatgcgattcaaattaatgttaagcacgcgggttttctccggatgaatagccgtcttggaagctgttgtaaagtctgtatagcgagttccagcaccaataatgagatccgcttttgcgaccacttcattagccgctgctgttcctagaatcccggtaccgcccatattattggcaaacgttgccgaaatagtggacttgccagttggtgtttcaacaatcggaatatttagcttatccgagaaagcttcaattgccgaaccggcttcactgaacttggcgccaccacccacaattaagacaggatagcgactggccttaatgagttgaaccgcttccgttacttccgccgcgctcggttgaatccgcttgatcacatgcacgcgcttattaaagaaactacgcggataatcataagcttcaccctcggtatcttgtggcaacgcaatcgtgaccggacccgctgtttcaggatttgtcagtacttcaaaggcttttaaaagtgcgctcatcagctgctcaggccgttcgatgcgatcccagtaccgcgacaccggcttcaacgcatcgttcgtggtagtagttgcgctgctatccacttcaatttgctgcaaaaccggatccggttgacgtgtggcaaatgtatccgcgggcaaaaagagaatcggaatgttgttcacgtatgcatttcccgccgccgtgacaaagttagccgaacccggacctgccgaagcagtcaccgcaaaaatcttatggcgatacaactgacggctataggcaatcgcagtgctggccattccttgttcgttatgcccttgataaacctttaagtgccccgggtcttcctgcaaggcttcccccaaacccagtacattgccatggccaaaaattgcaaagatcccttcgacaaacggggtgacctcaccatcaacatcaagatattgttggtttaaaaagcgcacgagggcctgcgcggttgtcaatcgaactgtatctgccgcggctgactctgcttctcgtccttgcgacttcaactccattgcgctcatcctaatgcacctcctgcctctctgcttcgtgaataaatgccgtgagtttcgccaaatccggcatcgcttctgaagaacttaattgactaatcacaatagacgctgcagcactgccatacttcaaggcagtttctattcccaagtcgtggctgtaagcatataggaacccggcagcaaatgaatcgccagcgccgaaactcttaagaaccttcgtcttgaaaactccaaaatgataatgatcgccggcttttgtatacgcatttgacccttgaaccccgcttttgatgacaattagcttaggatcatatttgaaaagtgtcgcaattgtctgctcgttcgtgttaccgtgatgattttccagaacatcaaattcgtcacgcgtgccaataatcacatctgcacgctgggcaactaattgataataaagactcgtttcctcggcatttttccaggtatacgggcgataatccagttcaaacaccacttcaaccccaagtgactttgcaactgtgagtgcctttaaaatcgcctctcgcgacgggctttgggctaatccggtcccggaaatcaccaacatcttggcttgcgctaaatattcttctgaaacatcagccgttgtcagatataaatcggcggcttcatttcgatacatcaaaatatcgctttcttcaggactaatgatttcagtaaacgttaagccaattttgtggcccgcatcatccttgaccatttgcgttgtgtcaatgccaacgtctgccatgtattgcgtcacataatgacccagctgatcatcggacaccttcccgatgaatcctactttttggcctaatttggctgacccgattgcaatatttgccggcgatccgccaacgaattttgcaaagctcttagtttcttctaaaggtcgattatattcaaccgcatttaaatcaactgctgctcgaccaatagcaatcaaatcgaatttttgtgacatttgaaatgttccccctcgtcaacttagctgcaaagctatcctttttcattactttcgatcaataatccaggcatgttctggcgcattgtgaaaatgccaaactcgtatcggtcccgccataatgttgaggtaataactgtcatacccatccggcacaccaacaggatgatagcctttaggaacaatcacaacgtcttggttttgcactgccatcgtctcgttaagcgataagtcatcggtatacacccgctgaaaaacaaatccttgcttcggctgcatttcgtgataatagatttcttccaacagcgattctgtcggtaaattatcgtgatcatgtcgatgtggcgggtaactggaccagtttccggagtccgtgtaaacctcgaccagcaataacttatccgcaaatgggagatcatccggcaagatgttttgaaccagacgcttattttgatacctgccgcgatgttcgatttgatgaatatcgcccttaatcaaccgaaccggaaatgaagtcgtggtcggcgagtatgcaatcagaaccttcgcggtagtttgtgcggcaagcttaaaggataagcccgttccaacataaacactgtctgtcggaattttgtcaaagactgattgccgttgaccgataccttcaaaacgctgatcaccggcagtgacggtcactttacccgccagaataacaataccggcctcgaagttacctaaagtctcggcaaatgaacgttgcgcatcaagctccaagactttcactgcggtgtatttcatgggagaattcgttgcattgacgtcttgaatcaaatgaacgcccggctgtatttcctgattttgctttggatacaacaagctcatcgttaatgcctcctcgtcaaacatctggaatttctaattaaaacgatgctggtcatatcttgccgtcacaaccttcttatgcgtgtagaagtccacactatccttgccgttagcgtgtaaggtgccaaagaatgaatgtttccagccagaaaatgggaagacagcaatcggtgccagaacgcccaagttaatacccagcatgcccgcatcaatattttctctgaagtagcgaatagatgcggccgaatccgtaaacaggcaagcgccattggctagttcggactgattggcaatggcaaccgcttccggtaaatcttttgcacgcatcacggacagtaccggggcaaacatctcatcgtgccaaatggtcatgtcggttttgacatcttcaaaaatagttggcccaacgaaataaccatcacgcttctcggcttctgctgacccgtctaagaccagcttggcgccttccttaaccccggtcttgatatagttcaacgtccgttcctgattctcctgacgaatcactggtccaaggaaaacatctttatccagaccattaccgattttgatgtctttagctgcctgcgtaaatttcgccataaacttgtcagcaatactttcttccagcaccaaaaccgacgtcgccatgcagcgttcgccggcggatccaaatgacgaactgataatgcctttaactgcagcatcgagatcagcatcggctaaaacgatcgtgtgattcttagcgccagttaatgcctggacgcgcttcaaatgatcactgccgcgcttatagacatattcgccaactcgttcggatcccacgaaactaattgccttgacatcgggatgatccaacagaccgttgacgacatcgtccgccccgttgacgatgttcaaaacgccatcgggcagaccagcttcttggaataactcaaccagacgctggctggtaagcggtgtcttttctgacggtttcaacacaaacgtattacctgttgcaaccgccatcgggaacatccaacacggaaccatcattggaaaattaaacggggtaatcccgccaacaacaccgatgggataacgataattcgtggcctcaacatcagtcgcaaccgccgagagcgaatcccccatcatcagagtcggcacgcctgccgcgaactcaacattttcaatcccgcggccaacttcggcaatcgcttcactgagactcttaccattttcctgcgtgacaatacgtcccaactcttcttgatgctccaccagcagttgttgatatttgaaaagaatcttggcacgtttaggaatcgacacccgtttccacgtttcaaacgctgctttggccgctgcaactgcatctgccacatcctcgctagtcgaatgcggcacccgtgccaaaacctcacccgtcggcggattataaacatcttcaaaagtatcggtcttagcatcaacccattgaccattaataaaattctcaggtcttaactgcttgttgcgttgcatgaaaacaacccctttgtatagtgagcgtgagccagcgcgcttagaaatccgagtgtaagtgggcctcaaacggtgatgggcggccctttggccattgcggctgaggtccttacacgcagacttctgcgctggcgaacgcgttatgagcgggaaccgggtgcggttagaaaccggagtgtaagtggcctcagacatgatgaccgccctttggtcattgcgtccaaagtcctcacgctggctccatcacccgtttacacacgctcctgtccaattcaagaatggtatgaagcgcttacattttcaaataaattgacttaggaaacttaattcttattaatcttgctcttttcagggaacttatcgtcaaacttgttgtccaattcgatttcctccaatgttctgcctgctgtttccggtgcaaacttccaagcaaaaatcagtgaaataatattggctccgacaaatacaaggaacgtgttcgacatgcctatacttgccaacataactgggaagaaatatccaacaaagaaattaccgatctatcagatgattcgggtgacatttgacaccaaaaatgagttctatgcttatatctcgacaggagtcatcatgatgatccgaccagaccgattggctccttcatgttcttaggcccaaccggcgtcgggaaaaccgaattagctaaagcgttggcagaagcgatgtttggttccgaggacgccatgattcgggttgatatgtccgagtatatggagaaattcagtacgagccggttaatcggtgcagcaccagggtatgtcggttatgacgaaggcggtcagttgacggaaaaggttcgcaacaagccatattcggtcgttttactcgatgaagttgaaaaggcgcatcctgatgtcttcaacattttgttacaagtcttggatgatggctatttaaccgatgctaagggtcggcgggtcgattttcggaataccattttgattatgaccagcaatatcggagcaactgccattcgcgatgataagacagttggatttggtgcaaaagatccaaccgctgacttcaatgccatgaagagtcggatgttggctgaactgaaaaagagtttccgcccagaattccttaatcgaattgatgaaactgttgtcttccatagcttgaacaaggctgagttgcatgagatcgtcaagattatgaccaaaaccgtgcttagtcgtatcaaagatcaaggaattgacgttaaaattacgccagccgggattgatgcgattgccgcggctgggtttgatcctgaatatggtgcgcgtccgatccgccgtgccttgcaaacggatgttgaagaccaactcagtgagctattgctggcgggtcaggctaaaaccggtgacttgattcaaatcggcgctaaaaaaggcaagctgacgtttacagtcaaggaaaacaaaggtaagcataaagaaaacggcgcttctaaagaacctgtcaaggcatgatcaatagcagccccaaatatgtcaggttccactaataacgcttaaaaagatcggtcttagaggtgaagcattatctctgggaccgatttattttgcaaaaacagtcagtgatggcgggatacgatttttgatgctatctggtattgcattactttgaaaagcaggtgcttgacattgttactccgcacgcgtattattaaatcaatcgcatttcggtttggacaggctgtcaggac

SEQ ID NO: 101 - DNA, 2587 bp, Lactobacilllus rhamnosus
cggcgccaaaatcgatcgggtttttgaaaccctagaacatcccaaaactaaaaaaagtccgcaattaattgtcgcccgacacgagcaaaatgcagcctttatggcagccggtattggccgtttgactggtaagcccggcgttgtcttgacgacttcaggacctggcgcttcgaacctggcaaccggccttgttacggctactgctgaaggcgatccagttttggcattgtccggacaggttaagcgagcagatttgttacgtagctcccatcaaagtatgcggaatgcggatctttttgcgccgatcacaaaatatgcggctgaagttcaggatccggacaacgttagtgaaattattgccaacgcttatcaggcggcagaatcaggcaagcagggcgcaagttttgtgtcgattccccaagatgtgaccgattcaccggtcaattccgaaccgatcaaaccgttagtggcaccaaagttgggaccagcaagccctagcgacatgacttacttggcacgtgcgattaaggaagcctcattgccagtgttactgttgggtatgcgtgcatcgtccagcgatgtgactgctgaaattcgcgagttgttgtcggtcaccgagttaccggttgtcgaaacattccagggtgccggcattatttcgcatcgccaaatcgataatttctttggccgggtcggtttgttccgtaatcagccgggtgatatgttgttgcaacatagcgatcttgcggggtattcgggctttgcacctgaaccgaaaatgcatgcgtcaactgcgctaaatcacttaaaggaaccaccgcagctagctgcagagcaatcaagcgtagtaacaatgaccaggccgccgtttttaacaataacgtctgtgcctgcatttgttcacgagccagaatcgaaaatcgctccggtgccaggttgtgcagagtcaggtgcaaaagtagccgctgattcgtgttcgctaatggcaattgccgcaagattccggccagcgtctgcacatccccgtggcgaacggctactaaataacggtgcaaaaacggtcgcttattatcggactgtggctgggtaaaggtatcccaatccaagttcaaccgatccagcaacaggaaaaatcgatcggcagctaactgagacgttccattttcaaattttgacagactcgataccgataaaatatcgcccgcagcctcttttagcgtaagtttgcgttctttgcgcatcaacttaaactgtttgccaattgtcaacttgaacgcacctcctcttcaagaaaccgctgccaacttttggtcaacaattgcgcgaaaaaaggagaatctaataacgccaatgtcgccaacaacttttcgatctcggctttggctgcccgatgctgacctcgatgatacatcagcagttgatgctggtaacgcagcatcaaccgcgaataaagatcgtccggcggtattgccaagttcatcgcaatatgccatagacgggtcgcatccgcaaactcacggcgatgaatcaacaaggcaatgctatttgtcaaaatagcccacaaatactgatcccgcaccggatgacttttagtatcaggcaagtccagaaccattccggtcaccaaattaaccaactgctcactgtcataaagcatcaaggtagccgcaaaaagatccagttcatacaagccccaatgccgaatccgttttagatacttgatcacatcatgcttcatcttcatagtggtctgaaagctcggatcggaaaattcattatgggctaaaatattaatctgattcaggcgataaaagacaaatcccgtttgccgccaaagctggtactgcttctgcgccaacgcctgcaacgccgacttacctgctaccgttgcccgttccacttcttgaaaaaagttctcctgattgagcgcccgatacccttgctgaatcgaggccacgtcttggtcaaatcgagtcaacagtttcaaaaccacagcggcactaagctgtgtctcgccgcgttcaaaccgtgacaaagtagcggccgttgtgatcccagccgctatttcttctaatgaatcattttcctcgagacgcaaagtacgtaaataggccccgattttgatagcttcctccgtcatcagcacccgacccttttatgagaactttattaaacaaatttaacacgttttgccattttttaaaatatctttttgcttgtatcttcctgatgatatgttttaatcaagtatgacaccgtttacatcaataaaacgaaggagaatagccatgagagaatcgcaaacctggatttcttttttaagcaccagaaaccccgccctcaagatgcgttcctttgggatactgtttcataaagacttgtctattagccggcccgtatagcgcttttatgagcttgttcatcaccggggaaatattatggactttttccgcaattatctttatgcgcatcgtggtcttttgtgctaatatagctgcagctatctcctatgcaaagaaaggaaccttggtaagcctttttaagttcaaaagaggtggctcggacaagcttttgcttcaacgttggg

SEQ ID NO: 102 - DNA, 2665 bp, Lactobacilllus rhamnosus
agaaaaaagtttggatccatttggtgtgtactttaattcgaagtcgagtatcccgcagtgttggcaaaccgcgatgttctttgcccagattaaacccgcccaaatatgccaaatgcccatcaatcacaatcagtttgcgatgattgcgaaagttgatgcgcggattccaccgtccgagtttggtcgccacaaatcgctccacctgaccaccggctgctgtcaagcctttccaaaagctaatcggtaaaccgtgcgaaccaaacgtatcgtataaaacgcgcacggtgatccctgcttgcgccttttcaatcagtaaatcacgcaattgccggcccactgcatcaggctgaatcgtataggcttcaatatgaatatgttcggtagccaagccaatatcttcaaacaactgtttaaaaaaggcttcccgcaaagaaagcacctgaacttcattgtgagttgtgaccaacgcatcgtccgcccgcaataacgtccgcaccagctccgaaaccccaccgctacctggcgtcccaatcaacggctgccctgccgcaagcgcttcttgttgctgaaccaccaaatcattaatacccagtagccgttgcgtcattaaatcctgcatgcgatccgcccgcagtttacgcccaaagacaaaataaattaagaaaccaacaaacggcagcagcaacagcacaagcagccacgcccatacagcagaaatatcacgatgggaccgaaacaccgtcacaatcgcaataaatgcattaatgatataaagaccgccaacaatcagcccaagccacataaatttcgcctccctaaccagacaatgtcacacctcagccattcgtccagtctctacatgcgattatcatactctactttacagataatcagggggaaaagtccagtgagcgcgagccagcccggttagaaacctgaacataagcggccttgggcgtgatggccgggttttggccattgcgcccaaggcccttatgtgcaggtttctgggctggcgaacgcgttatgggcgtaaaagcggactagtggcctcaggcgtgatgaccgggctttggtcattgcgcctgaggtccgtacacgcagacttctgcgccggtgagcgcgttatgggcataaaccggaacataagcggccttgggcgtgatgactgggttttggccattgcacccaaggtccttatgtgcaggtttctgggctggcgaacgcgttatgggcgtaaaacagaacataagtggcctcaggcgtgatgaccgggctttggtcattgcgcctgaggtccttacacacagacttttgcgccggtgagcgcgttatgggcataaaccggaacataagtggccttgggcgtgatggccgggttttggccattgcgcccaaggtccttatgtgcaggtttctgggctggcgaacgcgttatgggcgtaaaacaaaacataagtggcctcaggcgtgatggccacactttggtcattgcgcccaaggtcttgatgtgcaggtccctgcgccggtgaacgcgttaagggaggcgtgttgagcaaccaacaaaaaagccggaatcaaagttttcatgcagttacctgtcacaatagacagtatccacacaaccacaatgattccagcctcaacataaaattgccacgatgtctaaactctgaccccttatcagcgctaacatacaactcattgttcgaccttgccaaaccatttcttctgcagtttagcaatcgttccgtctgccttcaacgccttcaatcccgcgttaattttctctcgtaaaacatgatcggacttgcgcataccaaccgcgaactcttctggcgggaatgagtcgccgataatgtgataacttgcaggatccggcttgtgggcaatgtagtaacgtgcgtaaacctcatccattaaaatgccttgaattcgcccagcatccaagtcaataaatgcatcattgaaggtatcgtagaggatcggggttttgttggcgatcatattttttaacaatttgggttgggcatctaaatcaaacgccccgcttgatccggtttgcacgcccaaggttttccccttcatatccttcaacgtgttaatctgacttttggttttggtaaccagaatttgatggttaatcagataatcattcgaaaaagcaacctttgctttccgctccggggtcacggaatagccattccaaattaaatcaatggtctgattttttaattcggtttccttcatcgaccagtcgatggtctggaaatccgctttaatgccataccgtttgaaaaccgctttggctaaatcaatgtcatagccggccaactgcccatttttttgacgaaaacccatgggaacaaaggtatcatctaacccaatcacaacttttttggtccgttcaatgcgcggccaggagttgtcgacggtttcgcgcgcgcatccactgattacgataccggccatggtcaaaaacgccatgacggccattatcattcgccgtttcattgaccatcaccgcctttgccaacgtgataagtcgtgtctgcaacactttgggcaaagtccatgtcatgggtcacaaccacctgagtcatacctgatactttaaattggttgaccattgcggcaacattatcgcgcaacatcggatccagcg

SEQ ID NO: 103 - DNA, 2634 bp, Lactobacilllus rhamnosus
cgctctagaatcgatttaattcatttagggaaacgaatgatatgagtgagtagatttgatgagactgtacagaaaacctggttggctgagagcagggtagttgattgaattgaagatggctcattgatcggcatcgctgagcattggttaagcgatgatggctggcggtcattattccgcacacaggttattgcctgttactgagggcgctttggcgtcgaattagaatggtaccgcgagttaactcgcttctaaaacattgttttggaagcgggttttttttaattttcggcaaattgctgacacatattgtttgtgacccgaacgaggaggaaaaagtttatgaagttttggaaaagagccattataacccttgcattggttttacctgtcttcgtcttggcggcgtgccggtaagtcgtcatcgagttccagtaagaatgagacggttaaagtcggcattatgagtactgacaaagaaatctggaccgatattcagtcccgcttgaagaagcaaggcgtcaccattaagttggtgcagtttactgattataaccagccgaaccaaacactttgaagatggcgatattcaactgaacgcttttcagcatcataatttcctgaataactggaataagaagcacaataccaagattgccgatattggcgatacttatatcggcccaatgcgtgcgtattccaataaaatcaagtcacttaaagaggttaagcaaggcgatcagatttccttgccaaacgatccatccaacgaaggccgcgcattacaacttttggcacaaaataagttaatcactttgaagaaaggcgttgcttcaccaacgatccgcgatattacttcaaacaagattaacttgaaattcacggaactggatgccgcccaaacagcacgctcattgaacgatgtggccgttgcggttgtcaacaatgatattgccgcagcagctaatctgaaaccgtccaacgcgattgccgttgaaaagattacgagccaatccaagccgtgggtcaactttatcgctgctaagtcttctaaggataagaacaatgcaacctataagaagattgttaaggcctatcagacaaagcggacagctaattgttgaagaaggtttataaagggtcaacattaccggcttggaactataagtttaattagaaacggggacaatttatgtcaagatcaagcagttgtgactttaaaagatgtggacgtcgaattccacggtaaaaaccgttcagtccatgccgttgaccatgtaaacctaaccgtcaaccgcggcgacatttatggcattgtcggctattcaggcgccggtaagtccacacttgttcggacaatcaatttactgcaacggccaactggcggcagcattcatgtattaggacaggatatgcttgctttatcaccggcagaattacgtaaagaacgtaaacggatcgggatgattttccagcattttaatttgatgaatagccgcaccattgccgataatgttgcgtttccgctaaaaggtatcaagtccaagcaggagattcaaaagaaggttgctgagctgttagacctcgttgggttgacagatcgcgccaatgcttatccggcccaattatccggtggccaaaagcagcgcgtcggtattgcgcgggcgcttgcctctgatcctgagattttgatttcagatgaagcgacgagtgcgttggatcctaaaacgaccagttcgattctggaattactgcagtcgctgaacaaacggctgggactgaccattgttctcattacccaccaaatggaagcggtgaagcagatttgtaatcgggtcgccgtgatggatgccggcgcgatcattgagcgtggtgacttattgcaagtcttttctgatcctaagcaacagttgactaaagatttcattgatacaactttgcaactggatcaggcaattgaagccgtgatgcagcagccggcagttaagaatctgggtgctaatgaccggctattgcgcttaacgtatgtaggagattctgcggataagccgctggttgccaagttgtttgaaagctatcatgtgaccgccaatatcttgtttggtgatattcaaatcctgcaggacacgccttttggcaatctgattgtggtgttatcaggtgctcaagcggatgttaatgccgggattcattatctggaacaacaggatgtcaagattgaagacattcttaagaaggaggcctaagcagatggcacaattttttacaaaatattttcctaacgttgttcccatctggtccggtgatggcggcgtaactcaagccattaacgaaacgctgtatatgactgctttaaccgcaatcgtggctggtatcttgggaattatcatcggcatcttgctagttttgactgatgaaggtgggttgcttgccaatcatccgttttactttattttggataaattggttaatattttccgagcggtccctttcatcattttgctggcgattatgacgcccgtgacccgagcaattgttggtacggggattgggccgactgcggcattggtacctttaatcgccggcacgaccccgttttacgcgcggcaggtacaaaacgcgttgttaacggtt

SEQ ID NO: 104 - DNA, 3269 bp, Lactobacilllus rhamnosus
actgtccaaggcggcggttccggtgccggcttaagccaagtggcagccggatcggtcacgatcggtaactcggatattttcgctcaagaaaagaaagacttgaaggccgatgatctggtggatcaccaggtagcggtcgttgccattgcgccggtggtcaacaaagatgccggggttaagaacatctcaacccagcaattgatcgatatcttccaaggcaagattacgaactggaaagacgtcggcggcaaagatcagcaaattgttctgatcaatcgtgcgcaaggttcaggtacccgggcaaccttcgaacagttcgggatcaagaccgataaagtcaagaccagtcaggaacaggattctagcggtaccgtttatcagatggtctcctcaactcccggtgctattagctatctagccttctcggcaattaaagatggcgtccaaaagctggcactggataaggtacaaccaactgataagaacgttacaacgaacacctggaagatttgggcttacgaacacatgtacaccaaaggcaaaccgaacgcatcgactgccgcatttatcaactatatccagtccaagaacgttcaaaagactctggttccaaagttaggctatattccaatcaccaagatgaccgttgctcggacttatgacggtaagattgaagaagttaacaagtaacctacccagcatcactaaataaaaagcagcatgtatacaaaaaccgcgatcaacgcaatgatcgccggttttcttattgtcctataaacttgagtcgtcaacattaaaaagcaatcctgacagccacagacatatttgggaggaagcatcactagcttgttacccaaagacagactgttcggattgcttttaatgaatcacgtcacacgattgaacgagaatttatgcatgatcctcaatggcgggttcgtgatggaatcgtgacatttgctgcttgcggaccccgcggaccttcgacaatgacaaaatcgacctgttcaccgggcgtcagacttttaaatccagactcattaatcgccgaaaagtggacaaaaatgtcaggctgcccttcagcttcaataaacccatagcctttatcgacgttgaaatttttgacccgtccttgcatcatagcctccgcttacttatcaaatccgtttgctgccgcttcaggataattggcttcaacaatcgcggcacaccgactgcataattccggcaatttgggatctgtgccgatatcggttcgtaccatccggcaacgtgggcaaaccgttcctttggcatgttcaaccacaacagccatatcctcaaattgttcggcattttccggtgccttcgcctcaagtggcgctacttcaaagtgactggtaatcagcaattgcatcacattggcttcaacatcatcgagcatgtcgcgcaccggctccgttgggtaaactgttaccgctgcctccatggacttaccaattaccttgttgtcacgggcaacttccaaggctttttgaacttcggaacgaaaatccataaacgctgcccagatatctaggagctgatcctcatcagcaaagtgggtcacatctggcatgtcggataacgctgcgtatgcttgtttctgcttaagatacggccaaacttcttcggcagtatgcggcaggatcggcgtcaacaacttggtcaaatccagcaatgcggtgtacataaccgtttgcatgctgcgacgtttaggatcgtttgcggcttcaatgtataccacatccttggcaacatcgagataaaaggcacttaaatcgttgaccaggaaactgctgatggttttctctaccgtagcaaagtcgtaggcatcatacgcttctttgactttggcgatgatctgattaaccgaaccaacaaataacgatccactgaacctagctgatcataggcaaccgcgtctttttccggatcgaaatcgccggtattggcaaccatgaaccggagcgtgttgcggattttacgataggcttctgacgtctgagcgaaattatcgactgagacccgaacatcagatgatgaatcaacagttgcaacccagagccgaatgatctcagcgccaaactgcttttcaatggttgacggcacaatcgtattacccaagctcttgctcatcttccggcctttgccatcaagcgtgaagccttgtgacaaaatcccgcgatacggcgcgattccggttgcagcaacactggtaatcaagctggagttaaaccagccgcggtattgatcggaaccttccagatataagtcagccgggaagctcagttcaggacgttgcgccaaaacagcttggtgtgatgaacctgagtcaaaccaaacatccataatatctttttctttagtgaacttaccatttgggctgtgcggattggtgtacccatcaggtaaaagatccttggcctcgcgctcaaaccagacgttggaaccatatttaccaaacaaatccgctacatgattgatcgttgcttcttcaataatcggctcaccgtcttctgcatagaaaatcggtaatgggacgccccatgcacgctggcgggagatgacccaatcgccgcgatcacgaatcatattgtacagccgcgttttgccccaacttggtttaaagtcaacggtatcaatggccttcaaaatctgatcacgaaaggcctcaattgacgcaaaccattgagtggtggcgcggaaaataaccggcttcttggtgcgccaatcatgcggataactatgggtgaagaagtccaacttcagcaaggcgcctttttcgtccaaagctttcgtgacgagtttgttggcatcatcataaaagacgccttcaaaaccaggggcattttcattcaggtaccctttggcatcaaccactgaaataaccggcaagccatatttcattccgaccttgtagtcgtcttccccatgaccaggggcggtatgaaccaagccagtcccggcatcaagcgtaacatgatccgcattcatcactagacttgtccgatcatacaacggatgcttggctgtcattttatccatttcagtgcctttaaaagtctttaagatcttagggtgttcccagccgacttcttcagctacccgatcaagcaactcggcagcaacgacatacttatgctcgccaacttgcacctggacgtattcgaagcgcggattgactgcaatgccgtagttggcaggaatggtccaaggcgttgttgtccaaataacaagtgacgtatctt

SEQ ID NO: 105 - DNA, 10303 bp, Lactobacilllus rhamnosus
gaagcggccatactcgccaataaagtcagatattagcagcccgagtataacgtcttgtgcatcgtctaaaagcacgataggcacccaccataccggtgtaaagatattaacggcatgaggcgtacgcctactctgccaacgcaggtcagtttccggacagaatccagaaaccccgcagaaccggtggtataacctgctgcggccgctgaaccaaaaccagtgcaccttccctttcgtcgagtgataaaccgtaaacatgtctgtagaagatactcacccgcttatcacgcatctgattgagccgcgtgagcgtctgctgaactgccattatcgcggtgatcgtgatattcctgtgtctggtctatttcgccaatgacatctatcacctggtatccgcgccattgatcaagcagttgccgcaaggttcaccgatgatcgcctccgacgtggcctgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttgaagatggctgaccacccgatatttaaggaaccatgatggataacttccggtgcaagctttttgaccaaagaaaaaacaccgccaatgaaatggacggtgtgttgccgctttcattaaaaatttcggaagcgggcttgacgctgggtaaccagtgtctgcggatccaatgccataagggtcgccaactttggcttaacctcggctttgagtgcgctggggaagtcggtaccggtatccgtaattatccgatcacagacttttttagccaacaaatcccgcggggtcagttgcatgacttcagctgcttctttggcacggctggaatctttccacaaaatcgctgcaaagccttctggtgacaagatgctgtacatgcttttatctgtcatccagacttcatcaccaaacgccagcgccagtgccccgcctgatccgccttcaccaaccaatactgccagaatcggtgtcggtaaatcggcgcacgtgacgagcaagtctgcaatcgctgccccttgcccatttgcctctgcttctttacctggataggcaccgggtgtattaatcagcgtgacaatcggacgatgaaacttcgccgcctgtttcataagccgcaacgccttgcgataaccccaaggctccggactgccaaaatgggtctgcaaccgttctgtcaagtcattgcctttatcggtcgcaatcacagttgccgcttggtcatccaaccaaccgatgccgccaatgacagctggatcatcatgactggaccggtcgccatgtaactcatgaaaattggtgactaagccattgatgagttcgcgggtggtatagggacggggtgcgcgcgccgcttgaacggtggcgtaggcggatgtttcttttttgggcatgccagggtacctccttgcttcgtgttggtgctggtggggatgttttccgatgctgaaatgcgttcacagttacagaaatctgcgtgtatgggcctctagcctatatggccaaagaccggctggctcgggaaatcacttttgtttcggttggggacattctccgatgctgaaacgcgttcacaggcccagaaacctgcacgtaaggaccctgagcctaaatggccaaagaccggccatttaggctcagggccacttacgctccggtttctaagcgggcctgttcacgctctgtgcatttgtaacagttccccgatataatccgcttgttcgcttctcttcacgatggcgtcgatgaagccgctttggaggacggtttcggcgcgttggaagttttgcgggagtttttggttgatggtttgttcgatgacgcggcggccggcgaatccgatgaggctgtggggttctgccagtgtgatatcgccttgcatggcaaagctggctgtgacgccgcccatggttggatcggtgagcacgctgatgaacaataagccggcattgctgtgattcttgactgctgcactgaccttggccatttgcatcagtgaatgaatgccttcttgcatccgtgcaccgccacttgcgcagtataaaacgactggcagatttgcttcggttgctttttcaaacaaacgcgtggtccgttcgccagtcacggttccgagtgaccccatcataaacttaggatccataatgccaagaccgcatacctgtccgccgattttcgcctgaccggtccaaacgctgtcttttaaaccagacgcctgacgtcccgcggctagtttcttctcgtaacccggaaaatccagcgggtcggtcgtggttaaatccgcatcccattccgttgcatctgtcgctaccagggctaaccgttttttggccgtgatgcgaaatccataatggcaatgcgggcaaacttgggcatcgccgagactttcacgataactgccttgcttgcagtatggacattgaatccataggttttcaggcaaagccgcctcacgagcaagtgcttcttgggttagttgtggttggaacatgcagcatccttcctttcatcctgccattgtgggcaaaaagtcacggttgagataagccgtatcagcttctccagccaataccttgggtgcctggaaaagtgccagtgcaaagtcgcggttggttttgacaccttgaacgtctaactctgtcagggctcggtgcattttagccaaggccgactgacgcgtttggccatgaacgataatcttggcaatcatcgcatcatagtacgggctgattttatcgcctggcgccacgccggtatcgacgcgcaaacccagtccgccagtcggaaaacgtaattgttccagcgtcccgacatcgggcataaactgatgatccggatcttcggcattgagtcggcattcaattgcaacgcctgaaggttccggcgtggtcaactccacgtcttcgcctgccgcaatgcgcaattgtgcctgaaccaaatccacgccggtcaccatttccgtgatcggatgttcaacctgaatccgcgtattcatctccatgaaataaaaatgatgctgctgatccattaagaattcaatcgttccggcattgaggtaatcaacgccgtcagcaatcgtttcggctaaatgcaacagcttagcccgttccggtgacgttaacaccgggcagggactttcttcgatcattttctgactgtgacgttgcaggctgcaatcacgctcgggaaaaacgctcacgtgcccttgctgatcgcgcaatacttgaacctcaacgtgtttagccgggacaatcaccttttccaggtacatggtgggatcaccgaatgcagcttgggcttctgcctgcgcaccggcaaattcggctgtcaggtcatcggcactcgccaatttacgaatacctttaccgccaccgccagcactggctttaagcatcagcggatagccaatcgcctgtgcagccgccaatgctgtatcgacatcctgaagcggccggctgccagggatcaccggcacaccaatatcaatcatcgtttgacgggcaacggctttatcacccatttgctcaatggcagtcggcttgggcccgatgaaggctaacccggcatcagtcaccaacttggcaaattcggcattttcggataagaaaccaaaacccgggtgcaccgcctccgcaccgcttaaaatggcggcactcacgacattgcgcatattcagataagaatcagttgcccgcggaccaccgatacaaatcgcttcatccgccagcaagacatgtaggctgtggcgatcggcgttcgaaaacaccgccaccgaggtgatgcccatttcccgcaacgtttgaatgatacggaccgcaatctcgccacggttggcaacgagtacttttttgaacacagttccacttccttacacgagtctgaatcgggtcgatttaaccaattgcaaagacaagttcggcactgcaagccatatcttcgccgacgtaaaccttgccttttcctaagccggcattgtcgatcaatttctctaaagtgacctcgatgcgcaaaacatcgccggggcgtaccatgtgacggaacttggctttcttaatgccgccgagataagctgttttacctttaaagtctggcatcgaaagcaaagcaattgcccctgcttgcgccatcgcttcgatctgcaaaacgcccgggaaaatcgggttaccgggaaaatgcccttgaaaaatctgttcattgatagaaacgttcttttgtgcaaccacagattcgccgggtttgagatccagtacccggtcaatcatcaacatgggataacgatgtggcaaaatcgcctgaatttcttgtgcttcaagtgtctttttggtttcgagcatgaatgctatcctcctaaaacgtgtttatggagccggaatgcgactcggtttacgctttgtcttcttgtacgatgagcaacggctggtcgtattcaactaagctttcgttatcgactttaaccgccttaaccgtgccgctaacagtacttttaatctcattcatcattttcatggattcgatgatgcaaacaacgtcacctttttttacgtgatcgccgacttgaaagtacggatcagcgcctggtttaggagccaaataaacgattccgaccagtggcgctttgaccgctgtgccttcatccgcttgcggcttgtccggtaccggcgtgacaggtgtcgctgccgtattttccggagccggggtcacaggtgcaggcgcggcagcagggcttgctttgaccaaatgtagcgagtcgttaccaagtgtcagttccagctcgtgcagcgaactttgctccaactgtttgatcaaaacttcgatcattttggtgtccatgacactcaccaccttttgaaggccaaaacggcattatgaccgccaaagccaaaggagttactcaatgcataatcgactgatgtatcacgattgtcgcgattaaccagcgtgaccgggcaatcctcgtcttgagccgcatccaccacattcattggcaaccggccgctttgtaaggcacttagcgtcatgatcgcttcgatggccccagcagcacctagcagatgtcctgtcaatgccttggttgagctaaccaacacatcgtcgccgaaaagatcatggatggctttactttccatcgcgtcattggctttggttgctgtcccatgggcattaatgtagccgacttcacttggcttaatgccggcttcttcaacggccaattgcatcgcacgtgccgcctgagagccacttggatcgggcgccgtcatatgataggcatcactggtggcaccatagccaaccacttcacctaaaatcttagcgccgcgtttttgtgcatgctctaggctttcgagaatcaatgcaccgccaccttcgcccaaaacgaaaccattccggtcagccgcaaatggcaggctggccttggttggatcggtatttttggacaatgcggaaagcgcagcaaaaccggcgattccgatctcgttaactgaagcttcggcgccgcctgtaatcacaacatcggctttaccggtttgaatccgcatcgctgcttcgccaatcgcattcgtagctgaagcacatgccgttacgacaacatagctggggccatgcgtaccaaagtaatgggaaattgccctgcgaccatgttactgatggcttccggcacgaacagcggactcacgcgatccgggccttttacatacatcttcgtcacttgttcctgaatggttgtcaaaccaccaatcccggaaccgaaaataacgcccactcgatctgaatcgaccgcatcttcagttagaccggattgttcatatgcttcaatggcactatagagaccatattgggtaaacagatccatccgtttacttaggcgtttgctcatccgttcttcgggtttgaaatctttgacttcaccagcgactgtgattccggttttttcagcatcaaacttggtgattggctggatgccgaccttgccagcgtccatcgtcgccacagtttcggcgactgaatggcccagcggattcacagtacccattccggttacgactactcgttgcaatgtcattcctccgttcatgtacttaacctaatccgccggcgacagtcactgtctgaccggttatgtaggcattttcgaccagaaaacgggccgtgtgggcaatttcttcaggttgaccgaaccgcttcaacggaatttccgccagaatctggtcctgactggattggctcaaggcagcggtcatatcggtggcgatcatccctggggcaatggcattaacgcgcacgccacgcatagccccttcacgagctagcgtcttagtcagcccgatgatgcctgctttacttgccgcataattggcttggccgatattaccggtcaaaccgaccacactggccagattgatgatgacgccagcgcgggcctttagcattttcttgaaggccggttgggtaacataaaaggtgccatccaagttaacctgaacgaccttggcaaaagaagcgggtttcatgcgcatcgccaacatatcgtcggtaatgccggcattattgaccaacacatccacactgccaaactggtccaaggcagcggcaaccaattgatcaccggttgtgggatcatccacaactgcccagcacggtcacaacaccgtggccatagtcttctaattctttgatcaaagtttccggaaattcatgccgtgcattcaagaccaagttggcccctgcttgagcaaaatttctggcaatcgcttcaccgatacctcgtgaggcaccggtgatgatcgcggttttatcagttagtttcaatctgccttcactccgttattcaaatcggctacctcattgagacttgctgcatcacgaatcaggtaggttgtcatcttgcggtcaatgcgtttaatcattttactaagcaccggtttcgggcctaattcaacaatcgtatcaacgccttgtgctttcagttgtgcgatcacggcagcaaacttcgtcggttcggctacttgcgccgccaataccggtcggatgttgctagccgaaaatggcttaagtgccgtcgtactaatgaccggaatcactggttcaaagacatgagccgctgccagtgccgcttgtaatggtggttgtgcacttgccattaacggactatgaaagcccccggcaacttgcaaaggaatggcgcggacaccttggtctgtcagccacttttcaaccgttgccaagtcatcatgtgtccctgccaaaaccgtttgcttcggaccattgtaattagctggccaaacatgttctgcctgctgacaagctgttttgatgatggtctcatcgccgctcatcaccgccagcatgccgcctggttgttcttgacacgcggcggccatcgctttaccacgggctgcaacgagctcaagtcctgattctaagctcaacccgccacctgcgattaatgcgctatattcgcccagactcaagccggctaaagcagcttccggcggcaactctgctgaggcaacctcatgcatggccacactataagcaactaaggccggctgtaggtaatccggatgggccgcaaaatcaccattagccaaaaactctggcaagtcaaagtccaaaacggcatcggcacgatcaataatctctttgaatatcaaagtattctggtaaaaatcaatccccattccggggacctcggcaccttggccgttaaacacataagcaaattgcaaaaagtggtacctccttgcctgcgtttgggttacgcttgcacgtcaacctgactagtgagcaaagccgccattttcgagccggcgacaatttcttttgcctgctgcatgacttcttcaacaatgtccttgctgctttcttcgcgtttcactaatccggcaatttcgcctgccataaaggatccatggtcgcgatcgccttctaaaacggctttacgcaaactgccattacctaattcttccactgctgtaaaatcagtggtgccagaaagcgcaatttctttttccagtttgagataattgcgactcatcgggttcttcaagacgcgggctgcatgaccgacatacataccggtaacaagggtatcaacgtcttttgctttaatcacagcgtctttgtagttttgatgaatgcggcttgatgttgaggttaaaaagcgggtccccatttggacaccaactgcacctaaactcagcgcagccgcaacaccgcgaccatcgccaataccgccagctgcaacgaccggaatatcaacggcatctaccacttgcggcactagggccatcgtggtgatactgccgatatgaccaccggattccatgccttcagcgatcacaccatcaacgccgtcacgagccatgcgcttagccatcgcaaccgacggcacaaccggcatgaccacagtgccgttttgctggagccgttccagatagcggctaggatcgccggcgccggttgttaccaaggcaactttggcatcgacaatcacatcaatcacctgttcgacaaacggtgacagtaacatcacgttgacaccgaatgccttgtcggtcattgattttgcaacttcgatctgttccttaacccatgaagcaggtgcatgaccggagccaatgataccaagaccgccagcttcagaaaccgacgcagctaatttgccgtcagcgacccacgccatgccgccttgaaaaagcggatatttaacgcctaaacgttccattaatggactcattggcccactcctctccagtgtcttaagcttcagccttttcagtgatgaacgtaaccaaatctgaaaccgtttcgatgctttcgtcagtatcgatcttaacgtcgaattcgtcttcgatttcattgatgatttcgaaaatgtccaagctatctgcatccagatcgttcttgaagttcgtggtcaaggttacttcttcaggcttcttgtccaattggtcagcaataatactttgtaccttaggcaatacttcttcgttagtcatgtttatatgttctcctttgagtgttaagttttgaccgtttcattggtctgtcaattgtaaccgttagttagtaagtcatgataagtgagccaacagacaagccgccgccaaaaccgctaagcactattttctggccgcgttttaactgaccgctttctgccaactgtgccaacagaatcgggacgctggctgcgctggtgttaccatactcatcaatattgatcggaaattttgcttccgcgactttcaactttttattcactgattgaacaatgcgcgcattcgcttgatgaagcaaaaaccagtcaatgtcatctgttgtcagattagcttgttccaaagcccgattgatcgagcgaggtacttcgctaatggcaaactggtaaaccgcgcgcccattcattttgaaatatggcgacgcttgcgcttgtgcatcggcaagggggctttgatttgcttgctccccagccaacaacaccatctcggtatcaccgaaactctttaaatcaactgcttgaaccggggcgccttgatcactaaccaaaacgccgccagctccatcagcgaacaaaactgctgtgcgccgatcatgccaatcaactaaccgggaaaggacttcactcccgatcaccagtccttgatgaacggtggggctggtcatcagccgatcagcgacatgcaacgcatattcaaaaccggcgcaagcaacattgagattaaacgcaaatgcgtgattcgcatttaaagctgcttgcaggcgattagcctcggccggggtggcgtagtccgggctcatggtcgccacgatgatgaaatcgagctgatcggcggtgaccgtcgatttttctaacaattgttgggcgacatcataggctaaatcaaagttacgctggtcagtgaccacatgccgggttttaatccccgtgcgttctctgatccaaccgaaattaatgatgtgccgctgccaaacggtaagattaagagtctgcgcgcctcctattattttatgggcgcgttattagggcgctttggcaaagcaattgttgggctgcctggtggcgatgatatcggtccgcggcctatt

SEQ ID NO: 106 - DNA, 1044 bp, Lactobacilllus rhamnosus
attcgagaagcgatgctaaaaaaatcgcgctcatcaaagttagagcggcgcggcaaaacgattagcctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatggaaatccggaagttggcgctttaccgatgattgtcgggtctttcggcgtgacttttttatcggcaatcgttgcaacgccatttgcagttggcgccggcattttcatgaccgagatttcccacaagtgggggcaaaaagtgctacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgactgtaacatccatgaccgtcgatgcgttaaaagctgtcccgcgccattatcgcgaggcttcattggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggccttgttgccaaagaaccttgtttcgccagcttcgacgttgacttctgttttgacgagcgggattggtaatacagtcatgggctcgctggaaaataacgctttatggtccttggcattgctactgttgctgatgtcattagcctttaacctgttgattcgttggatcgggaagaaaggggagctgaacaaatgaatccaaaagttgtcgataaaattgccacaacggttctgtacattgtttcagggattatcattgttattttggccagtctcctcgggtacattctttttaaaggggtaccgcatatttcctggcattttc

SEQ ID NO: 107 - DNA, 2778 bp, Lactobacilllus rhamnosus
cagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacctgtaagattcgtgaagaaaagattcaaacgccaatcatgattctgacggccaaagacaacgaaaccgataagatcgtcggacttgaacttggtgcggatgattatgtgaccaaaccgttttcgccgcgggaaattattgcccgaattaaagccatcgaacggcgtagtcaaagtcaaccacaagcgccacttcccggtaatgccaatcaaattacggtcggtcaaattacgattgatcctgaaaattataaagctagcaaagccggacaccgactccaattgacccctaaggaatttgaactattggtttattttgctcaacgagttggcaaaacgctatcacgcgatgctttgctcaatggggtttggggcttcgattacccggcggaaacacggatggtcgatattcaggtcagtcatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccgttagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaacttggatcggattcgccagaaaaaagagcccgagcctgtgattctgccgccacagtcgccgtttacgcttgtggcacggcgaattaatgccttagctgcggaacaaacccatttacgtgagaaagtcgcagtacggcagtccagttttgatcgtctgattgataatttgccactaggcgtcatgttgattgataccaataaggatgtcattttgcataatcatgccatgtcccagcttttgggccatcagattccgcagccgcggcacaattatctggacgatgttaagacttatgcgttggcccggatgattgagcacacttttcgccatgaaaagactcatcatcaggagttgaccgtcctggcaacccaaaagtcggttgatgccagtgtcattcctttaaaccaaggaactagtcgtctccaggtgttggttattttgtacgatgtcacgtatttgcgccaagtcgagaaaatgcagctcgattttgttggcaatgtgagtcatgagctaaagacgccggtgactgctatttccgggtttgccgagacactattaagcggggctaaaaatgatccggcgacgctagataagtttttgaagattattttcgatgaaagtaagcgactgacccagctcatcaatgatattctaacgttgagccggcccgaatcgaatcaaacggtgcaggcacaagtaccacttaagaagttagtcgacgatgcattgcgtaatttagctaaagtgattaaagacaagcagattcgggtggaggtggcaattgcaccagacttacaggttgtgaccgatgagcgcaagttaactcagattgtgcggaatcttttgaacaatgccgtgttttataatcgattagccggacatgtgacgatcacggcccaagtagtcgaagggcacttatcattggcggtcgctgatactggtattgggattcccgagacagagcaggcacggatttttgaacgcttctatcgggttgataaagcgcgcagtcgtcacaatggcggtactggtttgggtcttgcaatcgttagtgagctggtgaaaagtatggatggtcaggttgccgtttcgagtcaagtcggggttggatcgacctttaccgtgacattgccgatcagcaagcgccagcagcaagactgatgacatatttacagaacctttacattcaacgacatgaacatttacacgcaactgttaagatgattggagcttgaaatggaggatttcgtgtgaaaaaaattgtgaccctgttttcgatcgtatttttggcgctgttagcaagtgcatgtggcagcagtcatagttcgaaacagtctggtgaatcaa

SEQ ID NO: 108 - DNA, 2222 bp, Lactobacilllus rhamnosus
attcgttgttgctggaatgatgcggctgattagcgttgagtacgtctaaagcaattctacaaaggctgtaatcattgcaaaattcccccggtttcttcccttcccccagaagcgtagaatggcgttatacatggagaagcgtaaaaactagaaatggggaacagacatgaagaaatcgacgcgcaccatcctgattagtgtggtcgcagcaattgtcgtcattgtgggtggcttcggtgcctttcactggtaccaaggcaaagctgaaggcgaccaggttaaggccacggcccaagcctacacgaaagcttttgccaaccgccagtatgaaaaagccgttaaacaagtcgacactagccatctcaaaggtccgggctggcaatataccgccaagacgttggctgaacgcaatcaggccgttttcgaccggatcggcgccagcaacattaaaatcacggatctgaaaacaaccaattccaaagacggtacctatcaactcacttttaccgccaacatgaacaccaagatcggcaagctcccggcacagcattacaccgcgccgatcgttaaagtcggcgacaactggcgcattcgctggacgccaagcctgctgtttccacaaatggatggcaaggacacggttcagattagtttgacagctgccacgcgcgggaaaattctcgatcgtaatggccaggcgctcgccaccaacggcaatgtcacccaagccggcctggtccctggcaagctgggcaccggcgatgaacggaccgctaatctagaaaaaatcgcgactgcctgggatgtgaaaacctcgagtcttgaaacgctcctcaagcaatcctgggtcaccgatgatacatttgtgccggtcaaaatcgtcaccgactcccctgcattaaccggtgcagcttaccaaacaatcggttcacgtacttatccgctaggcgaggccgctgctcaactcgtgggatacgttggtacggcaaccgccgatgaccttaaaaagcatccgtcactgaccgccaacagcaaaatcggtaaagccggtttggaacaaatttatgaccattacttgcgcggtacggatggcggcacgatcgcgattcgcaacggcagcaatagtcatcccttgctagacaccaagccaattgccggcaagaatctgaaactgacgattgacgccaccaaacaaaaaaccgcttatacccaactagcaggtaaaagcggcagtgtggtcactatggatccaaccaacggcgaacttttaactttagcaagttcgcccagctacgatcccaatgccttcgtgaacggcatcagccaaaccaactatgacaaatacgccaacaacactgagctgccattcctcagccggttcacccaacgatacgcaccgggttccacttttaaaatgctaacggctgcgattgccctgcaaaacaaaaccatcacccctgacacaaccaaatctatctccggtctcaaatggcaaaaagatagttcgtggggcgactacaaagtgacccgcaccgttgacgccagcccggaaaacatgacccaggccttggttaactccgacaacatctggtttgctcaagtagcactgaaaatgggcgcctctgcttacctcaaaggtctggagccccttttcaaaacccaagccaacttacctttaaccatgaaaaaggcccaaatctccaacaatggcaagctcgcctccgaaacgctcttggccgacaccgcttatggtcaagggcagctgctgctatcgccaattgaacaggcggcgatgtacagtgccatcgccaatgacggcaccatgcagcagccaaccttgattcaagctgcaaaaggcaaacgtaccagcgtgctccaaagcaatgctgccaaaacggtcaaaaccgccttgacccacgttgtctccgatcaagccggtaccgcccatgacctcgccatcgacggccacaccatcgccgccaaaaccggcacggccgaactcaagcagaaacaggacacagacggcaaggaaaatggtttcttagtcgccatggatgccgacaagaatacctacctcaccgtcgccctcatcgaaggcaccggcagcggggatgtcgtgacggcaatgaagccttttgtggctagtttgtactagacacacttgctatcacattaaaaggagagaaatctcgatggacttgaagagatttaccgaagcgacc

SEQ ID NO: 109 - DNA, 1207 bp, Lactobacilllus rhamnosus
tcgtggtgatgaaccacggcattattgctgaaggaccggtcgaagaagtgtatacggctcaaaacatcgaacgggcattttcggccgatctttccaacgtgctgtttgcaaccaaggaaggggcgagcgtatgagttcattagctgaatttttcactgcgttaggaaagtatgatttcctccaaagcgcgttaattactgccatcatggtggggatcatgtccggtttgattggtagcttcattattctgcgcggcatgtcattgatgggggatgcgatttcccatgcggtgcttccgggggttgccgttgcttatatgctgggtgtcaacgtcatgattggggcttcggtgtttggcattatcgcggcgctgttgatcggctttgttgcggcaaatagtaagatcaaaaccgatacctcaatcggcgtggtgttcagtgcgttttatgcgctcggattcattttgatttcgatggcagaaagcgctacgaacttgcatcatattctgtttggtaatattttggcggtcagcgatagtgatattatgaccaccgcggttgtgttagggattgtcatcttgttcgtggtgttgttctataaagaattgttgatcacatcgtttgataatacctttgctaaaacttatgggttgaataccactgcgattcattacgcgttgatgctggttttaaccttggtaactgtttcggccttgcagacggtggggatcattttggtcgttgctatgctgatcacgcctgctgccactgctttcttatggacggatcggcttgaaaccatgctcgtgatggcagcaagcgtcggggtcatttcgtctatcaccgggttgtatttcagcttcacctttaactgggcatccggtccggcaattgtgctcgtagcggcggtattgttcgccatctcgttcgtcttttcaccaaaacaggcattctttagtttcagtaagcgtcagcggaccaaaacagccgcgacgactcaaaccgcggaggaagttattcgatgaagaagattttaattactgtaggtgctttaattgtgatggtcggtggtgtcttttggttcattaacagtcggagcacggctcaaaaagattcagcgagcacgaatcaaacgttgcgggtggtcacaaccaattcgattttggaggatatggttcaaaatgtcggcggcgaggggatcaagctgt

SEQ ID NO: 110 - DNA, 960 bp, Lactobacilllus rhamnosus
tacgactaaaagccctgaagatgtcgttgataatttagccaaaaatcccgatattcatgtcacgcctgatcaaggacagtcaggccaagatcgctgatttcgcaacacaactgacaaaagccaatcaggaagtcagcaagcgtaagagcaatttgaaggatcagctgatctctttgcaaaagcgtgccggcgactcggttactggcaatgtctattttgactttattttgaattccgacagtctgacggatcttgtcggccggtcattgacagttagcaagttgagtcaagccagcgccgaagctttgcaagccgttaaagactccgaagccaaggttaaaaacctgaaagctgctcaggaagctaaccaaaagaatctggttgctaccaagagccagcttgaaagtgataaagccaagattgatggcttaaaggcggatgctgataaggcagctgccgatgctcaacaaacgattgatgctaacaaagaaaagctggcagccatggccgctgatgaagctgccaaagctgaggcggctcaaaaagcagttacagctgttgctagttccaccgctagtgcatcaagcacttctgcttcctctagcacaaccgcttcttcaaatagtctcggctctagtaaagctgcatcttctcaggctcccgcttcagctggaagcagcacagtttccgtgtccggtggcagcatcgccggtaacgccgctaaatacctcggcgtaccgtatgtttatggtggcacatcacctgctgggtttgactgctcaggcttaatctattacgcagctaaagaagccggaattagcctgccacgtacctctcaggcgcaaagcacacttggctcatatgtttcggtttccgatctgagttttctaatgcgcagattttcagaagttattcggcgttaatcccttgatccactagtgtcgacctgcaggcgcgcga

SEQ ID NO: 111 - DNA, 2322 bp, Lactobacilllus rhamnosus
atacgttatgggttccggttttaggtaatgtcaatgccacttggttttatgtgatattcgttgttttttggctcgttggttttagtaatgcggttaatctgacagatggtttggatggcttggttgccggtcagacaaccatttcatttgcaacgtatgcagtgattgcggttcgtgaaggccgcgttgacgtgttgattatttgtctggtgactgtcggcgcgatgcttggatttttgatgttcaatcataaaccggcccagattttcatgggcgatttgggatccttggcattaggcgggatgctggcagttgttgccattttgcttcatcgagaatggtcgttattattgatcgggatcatctatgtgattgaaacagccagtgtgatcttgcaggttgcttcattcaaattaaccggcaagcgaatcttcctcatgtcgcctattcatcatcattttgaaatgaaaggctggtccgagtggcagattgacttgaccttctggctggttggactgatcgcaagctgtgtttatctggtatttttcctataaaatcaagctataaaaagaaggaacgattgtgaaaaacatttcggattatcgtaataaaaaggtgcttgtattgggactggcaaaaagcggcgtcaatgcagcgcgcttactacataaattaggggctttggtaaccgtcaacgataagaagcagttcgatgacaacaaagaggctcaggagttgttggcagacgggatgcgcgtgattaccgggcgccatccagttgaattgttagatgagcattttgagttgatggtcaaaaatccgggtattccatacagcaatccgatggttcagcgcgcgcaagaattgggcctgccgattattactgagccggagctagcttttcaggtatccgaagcagagtggatcggcattaccgggacgaatggcaagacaacgacgaccacactcatcgggttaatgttgaaccaacagtggcctcaccatgcgtttgatgctgggaacatcggcattccggtcagtcaggtggctcaaaaagcaggtaaagatgacaccattgttgctgagctatcgagttttcagctctgcggcattaagacattgcatccccatatcgcagtattaacgaacatctatgaggctcatttggactggcatggcaaccgcgctaattatgttgcggcgaaaatgcgcattacgatgaatcaaacgccggatgattactttatcatgaactgggatcttcccgaaatgcaccagttagcaaagcaaagtcaagcccagatagttccgttttcccgcaaacaggctgctggtgcacgggcttcgttaattgatggctggttgacgtttgatggtgacaagattatgcctgccagtgacatgcagattccggggttgcacaatatcgaaaacgccttggctgccattgccgcggccaaactgaagggtgtgagtgatgacgcaattcgtgaggtgctgcggactttttctggcgtcaaacaccgaattcaatatttggaaacgatcaatgggcgtcgggtatacaatgactccaaggcaaccaatgtcgaggcggcaactgtagctttgaatgcatttcagcagccaattgtttggttggcaggcgggcttgatcgtggtttgccgatggacgctttaaccccgctcgttaagaaacacgtcaaaagcatggtcgtattcggtcaaaccgcgccattaatggcaaaaattgctaaagatgccggtatcccggttcaaaaaaccgagaatgtcatgacggcggttccattggcctatgaagccagccgccccggggatgtgattttactttcgccagcagcagcaagttgggatcaatatcctaactttgaagtgcgcggcgatgatttcatcaaggcggttcatagcctacagcaaaatcttgaaagcgagggtcattaaatgcggctggttatttctggtggcggtactggcggccacatttatccggctttagctttgattgaagccttaaaagcagaaggcaaacttgatgatgttttgtacgtgggcacgcaaagaggcttggaaagtcggatcgtaccggcaaccggcttgaagtttgcaaccctggacttgcaaggctttaagcgcagcctttcgttaagcaatgtgacaacggtcaaaaagtttatcggcagtctcggtcaagccaaaaagttattgcgagattttaagcctgatattgtcgttgggactggcggttatgtttcaggggccattttatatgctgcggcacggttgcatattcccacggtgatc

SEQ ID NO: 112 - DNA, 1123 bp, Lactobacilllus rhamnosus
acactccgattgctaaacgcgccggctcacgctcacttttagaggagaatttatgatagttaaacctaaaattcttgtaattgaagacgatcctgatctgaatgagagtattgttgattttattcgggacttttctcagcctgaagctgctttgacgggtgctgatggtttgtatttggcagaagaggggatttttgatgccattgtgctggatattatgctgccggagctgaatgggtttgatttgcttaaacagttgcgagctaagcaagtgaaaaccccggttcttattttgacggctaaagatgctttgacagataaggtgcgtggttttgagttgggtggtgacgattaccttaccaagccattccaccgtgaagagctcattatgcggttaaaagcattgttaaagcggacaggacatttttttgatgaggatgggttaacagccggtccgtttgaagtccacctaaaccggcacgaagtcttaattcacgacaaaccagtagcgttgaatggaaaagaattcgacttgttagtgtacttattacagaatcaaaaaaccattattacgaaggatcagatttttgatcggttgtggggatttgattcggatacggccgtcagtgtcgtcgaagtttatatgtcgaacttgcgcaaaaagttaaaaccgatgcaagccgacgtatggatcaaaacaattcgcaatgtcggttacatctttcaggaaccggaggaccgtgcatgaatgcagataaaggcattaagcgacaacagcgacgtttatttatcggtcaactactgagcttcgccggactttttctagtgctgggggtcattgtttttttcctttatgaacgttcgatttatcaagatatcgatcattcgctggaacaacaaaaaataatgcttaccaagccggcacaaaccatgagcggtgcaggtggtcccggacgcccggtgacttcacgaccagtaccttttcggatgaacatggtggtttttaataaaaaaggaaaaatcattaatcaggcgatgttaggtgaacggttttatgcctatttcaaaacgttaaaattagatcgtcaggcagttaataagttgcagaatttgccgacttcaa

SEQ ID NO: 113 - DNA, 1591 bp, Lactobacilllus rhamnosus
agcccgcgtaaaaaactcgccatgtttttcgacctcccatttctgtttaagcatagtctaccatgagtttttagtttagtggttacagtggtgctgtttttctgttactgggctgttacaataatcatgagcagttttgccagcttgatgttaaatcacggcagagctggatatcatacgtacagccgtgagtgactgttataatgcttgataacgcgtttactggcgcaggaacttgcgtgtaaggagctaagttgcaagggtcaagttgggccatcacgcctgaggacaccccttacaccccgatattctggcgcgccagcttacgtttagaggaggattttaccatgttgaaacttggtgtgattggaacaggatggattactaagcagtttgtggatgcagcggcggccacgaaggcatatacgcttactgccgtttattcacgtcatcaggagagtgctcagacgttcattgatcaaactgcaccagcaacagcgtataccaagatggacgattttctcggcagtgatgtcgatgtggtgtatattgccagtcctaacagtttgcatgcgtctcaagccttggcagctcttgatgccggcaagcatgtgattgttgaaaagcccttggttgcaaccgctatggaatttgaaaaactagacgaggcattacgcaaaaagccttctttgtatctttttgaagcagctcggcatgtttatgagcacaattttcaggttgtcgatcaatttacccatcatcatccgattgacggggctaccttgacttatatgaagtattcttctaagtacgatgcttttttggctggtaagttgccgaatgtttttaatcccgagtttgccggtggtgcattgatggatctgggtatttatttggtctacgatgcggtggcttggtttggggttcccgataacgctgtttacctcccgcattttctcaagagtggtgtggatggcgatggggttgcgcgcttggattatgatcaattcgccgtgacactgattacgggaaaaacaaccaatagtttcctgccatccgaaatttattccggtaagcaaacgttgactatggacaatgctgctgaacttgaaactatcaagctcgatgatcaagtgcttagtaccgagaaattagctaacccgatggaagcagaagcagcttattttgccaaagctatcaccggtcatgatcgcaatgcgtttgataaggcatggcagctggccaaggaagttcatcaagtcatgtcaattctgcggacgtccgcaaatcttgatttttagtgagcgtgaaccggcgcggtttctgcgccggcgaacgcgttatggaggacaaatattgtgacaattgcaaccccgtttcaaaaacgttggcaggctgccgggtatacggagcagacacccattcaagcagcggtttatcagccgttgaaaaccgatgaggatgtcatcggtctggctccaaccggctcagggaagaccttggcgtttggcctaccgttactggaaaaaatcgtgcccggtgatggtttgcaaatactgattttggcgccttcgcaggagttagcgattca

SEQ ID NO: 114 - DNA, 2196 bp, Lactobacilllus rhamnosus
ggagtgtaagcggcctgggcgtgatggccgctctttggccattgcgacccaggtccttacacgcagattcctgcgccggggagcgcgttaatatgagcgcgggccggcgcgggtagggatcggagtgtaagcggcctcgggcgaaatggcccgctcttggccagtgcgttcgaggtccttacacgcagattcctgcgccggggagcgcgttaatgtgagcgcgagccggtgcgcttattcgggaatcacatgcgtttggctaacctgttttaaccattcggcactttgcttgacataacgtttttgcgtcggaaagtcgacgaaaaacaatccgtaccgtttgctataaccatttgtccaggaaaactgatcctgcagtgaccagacaaagtagccttttacattcgcgccagcctgaatcgcatcggcaatggcacttaaatattttttcaaataatcaatgcgtttgggatccgcgatgaccgtatttggcgtcacttctgctggtaaggattctttcaatccaataccgttttcggtgacatagatggctggtactaacggataatcttggtgaatccgcatcaacatgtcatacataccacgcggatagatggaccagtcccaatccgttgtctcaatcccggctggcttcttctcctcgccgataccgtgaaggcgggcaactgacgatccctttgagccatcaccattatgaatcgtttccgacttgccgtgataagcgcgcagccatttgctgaagtaattattaacgccaacaaaatcaagctggtgcgccgccttcttaatagccgccatctcttcatcagtgtacttaaacatcggttgttgattggctgccagaatttctttgatcaaagccaaggtcttaggggcataatctcctgccagtgtgccatctaaatacagccgattttccaacgcatcctgtaaatcagcggcatgctgatcttccgacgaatcactatatggataaggtgtctgcaaggcatgcacgataccgatttcaccgtctagccccattgacttgtacaaattaacaatacgcgcatgggcaacgatttgattatgttcggcttgaaatgttttatcaaaatgaccggtttccgctggtggaaaagtaccgctcgtatattgttgcactgccatggacgttggttcattgatcgtaatccagtgtttgatttccggaaattcttcgaagcaaaaccgcgcgtactcgacaaaatcttccagcatttcttgactcagccagtcaccaatctcgtgtaaccgttctggtgtatcaaaatgatgcaacgttacaaacgggataagatgatgcttggcacaggcagcaaagagccgatgatagaaagcaacgccacgagattccaccgccccggcaccatccgaaaaaattcgcgaccaggcaattgaaagccgtattacttgatgaccatatgcttctgctaacgccaaatcctcatcatagcgatgataaaaatcagcggcggggtcaggactaaaccgcccttgtttttccagaaaatcatcccaaagaactcgaccttttccgtcttctttggttgccccttcaacttggtaagcagcagttgcgccaccgattacaaagtccttgggtaattgtttacgcatgttttaacttcctcctataaagtatgcagacgagtctgtctaagttgttgaacacctaaagattggactcaacaaaatccagtgccatatcaccgttgtttgtcagttcaatgtactggcgaccagtggttgtaaccaacttaacgccatatttatcggtaatctttttcaaattatccttcatactttccatttgtggcgccagaatgaccatactcatatctttgatcaagtccatatcctgtccataagcccgagccgcggcggacaacttcaacccccgctccttagacagcttgtttagcgcattggctaagatgccactggttccaccaccggcacaaagcaccagaacgtcaatttcattatttttgaagaaactctcatcatgcgctgccgctggtttttcatcagccatttcggatgcttcgacctgaacctcagccgtttgtggtgcaaccgtatcggcagccaaaaccgccgtatcctgtccttcaatcacatcttctttagctttttcttcggctaaaagcgttc

SEQ ID NO: 115 - DNA, 1537 bp, Lactobacilllus rhamnosus
tagtcgctgaggcgtttcttcagttgcagaatgaaggcaaagtgcgtcagttcggcgtttccaactttaatcctgctcaaatcgatttgttgcagcaagctgttccgcaacgccttatcatcaatcagttgcaattttcgctcatgcatactggcatgattgatgccggcatgcataccaacatggccgacgcacgttccgtcgatcatgatggtgcccttttgccgtacagtcaacaacatcatatgaccattcaggcttggagtccgttccaatacggtttctttgaaggggtcttcatcaataatgatcaattccctaagttaaatgcgctgcttcaaaaactagccgaccaatacaccaccaatcctaatgccatcgcggctgcttggcttttgcgcgttccggcgaatgtgcaggtcatcgccggcaccaccaaaccggcacggttgcgggcgattgccgaggcagcagatatcaccttaagccgtcaagaatggtatgatctttattttgcggccggtaacgacctgccttaagcctaaatgccattttgattggtagctatcagacaccaactcgtaaatgacctaaaaattgacacatttaatctttctataaagggagtttcgcatgaagaatcgactcgatgatattacagatttaatggcacttggtccgactccggatgcccgtgacattcagcgacgtcaaaccgcccaccgaatcgcaattgcagacgcttggcaaattcaaccaggcgaaaacatcttggaaatcggctgcggtcaaggtgacttaagtgcggttttggcagatcaagtgggtcccagcgggcatgtcaccgggatcgacattgcttcgcgcgattacggtgcaccgctcacactcggacaagcatgggatcatctgttaaacggaccgttagcaagtcggctgacagtacactttgataccaatctcgccgccagcctcggaccggttgccaatcaacattttgaccgcattgtgatggcgcatagtttatggtactttgcatcggccaatgcgtttgccttgcttttgaaaaacctgcgcaccattggcgattatgtcgatcttgccgaatggtcccttcaccccaccgcgctcaatcaaattggtcatttacaagccgcgatgattcaagggttactttatgcgattgcgccaagtgatgttgccaacattcgcactttaatcacgcctgataccttagcgcagattgcccatgataacacatggtcctacactgctggcaagctaatagaatgtccggatctagatgatgccaaatgggaaatcgccaccactaaggctttattgaccgagctaaaacttagtaccgatttgcgtgatcgcgtaaagccgcagctggaggccatgcagcataatggtaccgctagtttgcccacatttaccggtcgaatcacgttctaatgcatggaggcgtcagcatgatcgaatttgttcccgccaccaccgcagatctgcccaagattgttgccatttataatga

SEQ ID NO: 116 - DNA, 5805 bp, Lactobacilllus rhamnosus
  misc_feature (1)...(5805): n = A,T,C or G
gcacaacaagacgtcacgcctacgttggccgttgttttagttggttcggatcctgctagagaagtctatgttcgtaacaaacagcggccgggctgaagaaattggcgttcgctcgttgatgtatcgattgccagaagacacttctcagatgacattgttagctaaggtgtccgagttgaatcaggatcctgatgtggatgctattttggtacagcttccgttacctgctggcttagacgaacgcgcggttattgatgcgattgatcctaataaagatgttgatggctttagtccggttagtgtcggacggttgtggacgaatgagccaaccgttgtggcgtcaaccccttatggcattatggcgctgttggatgcttatgatattgatgttgccgggcagcgggttgtcattgtcgggcgctcgaatattgtgggacggccactggctggattaatggttaatcatgatgcgacggttaccatcgctcacagcaaaacccgaaacctcaaacagttgacgcgggaagcggatattttagtggttgctgtcggacggccacattttatcggcgctgatgccgtcaaacccggcgcaacggtgattgacgtgggaatttcccgcggtgccgatggaaaactgcatggggatgttgacgatgatacggtcgcaccgattgcaggcgccttgaccccagtacccggtggcgtggggccgatgacgattgcatcgctcatggcccaaacggtggctttggcgaagaggcggttacatggttgagacaagtcaatatttaaccgttaccgcactgacgcagtatttaaaaagaaaattcgatgccgatccgtatttagccaaagtttatctgaccggtgaaatttccaactaccgcaaacgcgtgggcaatcaatatttttcactcaaagatgatcatgccaaaatcggggctctcatgtttcgtaacgcattcagcaaacttcaatttaaccttgaagaaggcatgaaggtgttggtggttggtcgcgttagcctgtatgaacccagcggcgagtatcgactgattgtagagcgattagagccagatggcgttggtgccttgtaccaggcgtttgaacaattaaagaaaaaactggctgcggaggggttatttgaacgccatcagcggccactgccacttttccctaaacgcgtggcggtggtgaccagtccaagtggcgcggtgattcaagatattatcaccacagtggcccggcgatacccgatactgcagttgaccttatttccggctatcgtgcaaggggatcaggcggccgattcgattgtgaaacagttgaatcggattaagacaatgtccggatttgatgcggtgatcattggtcgtggcggcgggtcaattgaagatttatggccgttcaatgaagaaaaagtagcgcgggcactagctgagatgccaatgccgattgtgagctcggttggtcacgaaaccgacacaacgattgcggactttgtggctgatcgccgtgctgctaccccgaccgcagctgcagaaattgtcacgccagtcactttggtggatgccttgaatcgcatctcagaagatcaggtgcgactggtaaacgccatgcataaccgcttgaaaaatgcagcaacacgcttacaacgatccgcccaaagcgttgtcttaacccaaccggatcggctttacgatcaatatgttcagcgtgtcgatcaactacgacaacggctgtatcagagcattaacaatcagttacgctaagacaagctttggttagcaatggccactgcccatctggatggtcggcagttgctggtcaaagtcgccaacctgcagcggtagcaagtggatgatctgctttagctggattgggctttgatcgcacttgatacctgctatcatcaagcggtggccaatgcggcacttggcttggatgatttaagtccgttgaaaatattgggccgttgctttgtgtttgttaccgatgattcatgtaaaatgttgaaaaagattgaggattataaagtggatgtcgcgattgatattaaagttggggatgggcaaattggcgcccgtgtgacgacaaaggagaaaaaagatggctgaacccaacggtttgaagaaaaactcgcacaacttgaaggtattgtgaatcaattagaacaaggcgatgtcccccttgaaaaagccctagatcaatttaaagtcggggtcaaattgagtcaggaactcgaaaaaacgctgaaatcagcagaaaagacggtgacggaaatggtgagtgatgatggtaccacccaaccatttcagcccaaagaaggccaacaatgagtccaacgctaaccgactggcaaacagcaattaatcatactttagacgaacaattggcaactgtggtcaatccccatttgcgtgcggcgatggcttattcggttgatgcaggcggcaagcggttgcggccgttgctgttattgagcgttgttgctatgtacgatggtgtggttgccgaggcattaccggctgcagctgcacttgaatttgtacatacctattctttgattcatgacgatttgcctgctatggataatgatgatctccgccgcggtcagccgacgaatcacaaacagtttggcgaggcgctcgcgattttggctggggatgcattgttaaccgacgcattcgctatcttaagccagcactatccgggaaaaggtgccgaactcgttcaaattctggcagaagcggctggcagttcaggaatggttgcaggccaggtacttgatatggatggcgagcaaacgcaatatgacctagcaactctcaaacagatgcatcaggctaaaaccggcgcgctgatccaggccggtgtggcaatgggtagtttgtttgtcgcgattcccgaagccgatcaagctgccttagccgattttgcggctgcttttggtctgggttttcaaatcaaagatgatatcaatgatgtgactaaaaccaccgcggaattaggtaagactgccgataaggatgtggccgaacacaaaaatacatttcccgaactgctgggattagccggtgccaaacaagcattggcgacccagtttcagctagccactgctgcgttaaacagcctgaccgttgatgcagccgacttaaaatcgattttggcggtgttacaagcatgacaaaggtaaaaaaagaacgggtcgatgtactgcttgtggagcaaggcttatttgagtcacgcgaacaggccaagcgttcggtgatggctggcgaagtctatgatcagaacaatcaacgtttggataagccgggggtcaaaatccccggcgatgccattttgcatgtgaaaggcaaaaaaatgccgtatgtaagtcgtggtgggcttaaattggctaaagcactgaaagtatttgcgattgatttgacgggtaaaaccgtgcttgacattggcgcatcaactggcggtttcaccgatgtggccttacaaaatggtgccaaaatgagctatgccttggatgtcggctataatcaactggcttggaaacttcgtgaggatccgcgcgtgaaagtgatggaacgggtgaattttcgttatagcaagcctgaagattttaccgatggccccgtggaatttgccatgacggatgttagttttatttcgttgaaactcattttgccgccgctaaaagccatcttaatgccgcacggtcacgcggtggcactcattaagccgcaatttgaagccgggcctgcgcatgttggtaagcatggcattgtccgcgatccccaggttcatcgggatgtgttgaagatgatcgttaactttgccagcgccaccggctataacgttttaggtttggcgtatagcccgatcaaaggcggcgaaggcaatattgaatttttaattcatttgcaaaatgctgaccaaacccctggagaaatcgcaccaactgttgatatcgagcgaacccttagtgatgcgtatgctgcattaaaacgcccttaattgaatatttatgcaaaaatttggtaagcctggtgcgtctgcgctatgctatgggtaaagcatttttccacgttaaaaatgcattcatgacagaggtgagcacatgcgaaagcgcgaacgacaagcgacaattcaacggttaattcaaagtgagccgatagaacggcaggaagatttggtggcccgtttgaccgagatgaaaattccggtcactcaggcaacgatttcccgggatattaaggaaatgcaactggtcaagattccggcaggtgagggacactatcgctacagtatgcccgcggaaaagcagctgcccgctacggataaactgcggcggacattggttaccgcgatgaagtggggcgaagcaatggataattttgtccattttgggccgctttttggcccaagggacgggccaagcccgcgggtttggaagacggttggaattccgaaacaaaattgggaaccgaacccgggcgggaaatttttttttggcggaaccgaatttaggccgggnggattggcctttcccatttcttaaattaattttggaacggcttcgggcaaccagtattgcccaaaccgattgtatttgggcgggaaactttgaggccatggtggggtgaaaagatgttacaggagttagcaattcatgattttgccatcattgataacctggcgttgagctttcagtcagggatgacggcgctcactggtgagaccggggccggcaagtcaattattattgatgcggtgggtttgttggctggtgggcgcggatcttgcagacgtcaagtatagcggtcccgatttggcgaagttgcgcgatttttataccaagatggatatgaattctttgctgaagaaaatcggcggagatgtagccaaaccaacgcaaccggtgcatttttcggttttggatgaccaatcaattttgacgctgactaaaaccactgaaccactaacgtttgaaatcgaaatgttagcggataattatcacatcgcggatcatagcgactcagcggtgacgttcacccagcaccaaaattcagaaaccttgaaaaagttcccgtttaaatatactttagccgttacttatatgctaaccgaagatggtctgagcattcattacaccgtgacaaatgatgacagcaattcgatgccgtttgcgttagggttccaccccgccttcaacgttgcattaaaggcggatggcagctttgacgactacgatttgacggttgaaccgttaaacagcccgttgcagcgctttggtatcgggccagtaccgtttcgcaatggtgacgttgaagatattgcaggcgcagaaggcaataaattgccactcacacatgatctgttagacggtgggttagtgattcttgctaacagtgaaatcagcaaagcaaaccttatcctccccgcatcacaagcacagtctcacgcttgatatcaatgacttcccttatcttactatctggagtcctgaacataaaaaggctccgtttattgcggtttgaccggttgacgggttacctgaccaagccggcgaacaatccgaatggtacacctaacttggcaacaacacacttttttggagtgccaataaacaggttggctttgaaaatgaattgcattaaaaaatttttaatgccgcctggagtttatgcaaacgcttttttgtgccacttttggacaacaccatcattaacgaatgaaaatagtgcgggccaataccccaaacggtgaaaggatgagggttatgccattgcgtcatgatgacac

SEQ ID NO: 117 - DNA, 1669 bp, Lactobacilllus rhamnosus
ggccatcacgcccaaggccacttatgctccggcttctaaccgcgccggctcgcgctcactccttataaaaatcttgccgaaataagaaacacatggtataattgcaaatttcttgcattcgtgttatgatgtatttcaagaggtgaagtgcatgccaatcacactagcaagcatcaaacggaagctcgatgggaaaatcggtgagaatttaacggtcgttgcacaagcaggacgcaagaaggttactcggcgtcgggggaccttgaaggaaacttatccggctatttttgtggtcgatctcgaccagaatgaaaatgcgttcgagcgtgtctcttatagttacgcggatcttctgactaagtcaatcaagatcaccttcgaaggcgaagaaaaagcgtcataatttcagatactaaccgacgattaaatcgtttattttgagcaggcctcgatgtcattggcatcgaggccttttgctatcttcttgaaagactgatctgtacaaggtgacgaatttttgacacgcggcaatgaaaatccggacgcaaaacagtatactgaaaataacgatacggcggatgcatgcatcgtcgtttgcagtgtgagctctccctgtaaatacatgcatcgccagagactggtggttagatggaactgatcgagaaagcgccggccaagattaatctaagtttggatgctttgtatcgtcatgctgacggcgaacatgagtggcagatggtgatgacatcagttgatttggctgattacgtgagcattaagcctagccatagcattcaggtttccacagatagcggttttttacctgaagatccgcgaaatctggcctataaagcggcattggcgctccaacgccatgccaatatccgccaaggtgcgcggattcatattgaaaaacacattcccgtcgctgcaggtttgggcggtggttcgagtgatgcagctgccgttttgcggggcttaaattcactattgcagttaggttatagtcgctcgcagctggctcgcatcggcttacaggttgatagcgatgtgccttactgcgtttactcggagacggccttggttaccggacgcggcgatgtggtcacgccattgggaagtttaccgaacttttgggttgttttggctaagccgcgggtgtcagtgtcaacgccaagtattcttaatgcaattgactatcaggccggccttttgcacccaaatacacctgaagtcgtttccgggattcaaaaccatgatttcgcccaaatgattagcggaatggggaatagtttagaggccattacggcaagtcgttatcctgaaatgaccgcattgaaacagcggctaaaaaagtacggcgctgaaatcgctcaaatgtcaggtagcggtccaacggtgtttggtctttgtcagaagcattctcgggcaatgcgggtttacaacagtatgaagggattttgtcgtgaggtttatctgttgcggccattttgcctgtcaacgaatagtcatcggctgaggggttgatttttaggtagcactaaaccatgatggaaaaggaaactgaggagctgatgataagatggaacaagttcagccaaacaaggcctttttctggggtattctgcttaatttgatttacattattgccgaggttgcttttgggatc

SEQ ID NO: 118 - DNA, 1137 bp, Lactobacilllus rhamnosus
ggcatggactgaacggtttttaccgtggaattcgacgtccacatcttttaaagtcacaactgcttgatctgacataattgtccccgtttctaattaaaacttatagttccaagccggtaatgttgaacctttataaaccttcttcaacaattcagctgtccgctttgtctgataggccttaacaatcttcttataggttgcattgttcttatccttagaagacttagcagcgataaagttgacccacggcttggattggctcgtaatcttttcaacggcaatcgcgttggacggtttcagattagctgctgcggcaatatcattgttgacaaccgcaacggccacatcgttcaatgagcgtgctgtttgggcggcatccagttccgtgaatttcaagttaatcttgtttgaagtaatatcgcggatcgttggtgaagcaacgcctttcttcaaagtgattaacttattttgtgccaaaagttgtaatgcgcggccttcgttggatggatcgtttggcaaggaaatctgatcgccttgcttaacctctttaagtgacttgattttattggaatacgcacgcattgggccgatataagtatcgccaatatcggcaatcttggtattgtgcttcttattccagttattcaggaaattatgatgctgaaaagcgttcagttgaatatcgccatcttcaagtgcttggttcggctggttataatcagtaaactgcaccaacttaatggtgacgccttgcttcttcaagcgggactgaatatcggtccagatttctttgtcagtactcataatgccgactttaaccgtctcattcttactggaactcgatgacgacttaccgcacgccgccaagacgaagacaggtaaaaccaatgcaagggttataatggctcttttccaaaacttcataaactttttcctcctcgttcgggtcacaaacaatatgtgtcagcaatttgccgaaaattaaaaaaaacccgcttccaaaacaatgttttagaagcgagttaactcgcggtaccattctaattcgacgccaaagcgccctcagtaacaggcaataacctgtgtgcggaataatgaccgccagccatcatcgcttaaccaatgctcagcgatgcc

SEQ ID NO: 119 - DNA, 1221 bp, Lactobacilllus rhamnosus
gtgggccagatcatccttgccggcgcgatgcagcagctgccggtcaatatgcttggtggctttgcagtgattctgacgatgggctggttgttagggacaattggtgccaacattccggtggttaagaatttcggcgggccagccatactgtcgttgttagtcccatcgatccttgtgttttataacgccctgaatccgaatgtgttaaaagcaactgacatgttgatgaagcaagcaaactttctttatttctatattgcatgtctagtctgtgggagcattttggggatgaaccgcaagatcctgattcaagggttgatgcggatgattattcccatgatgcttggcatgattctggcgatgggtgtgggtactttggttggcgtgttattgggtctggagtggaagcatacgttgttcttcatcgtgacgccggttttggctggcggcatcggggaaggcatcttgccgctgtctctaggatacagcacgatcacagggacgaccagcggcgcgcttgtggctcagttaattccggcaacgattatcggtaacttctttgccattatgtgttcaggtttattgaatcggttgggagagaaacgtccggagttatccggggcagggacagttgttcgactgaatggggcagaagaattggcagacgcgttgaagaccattcggggaccgcttgatctaaaaatgatgggcgcaggcgttttcaccgcatgtaccttgttcattatagggatgttgttgcaatcagtgcccggatttccagggcccgttttgatgattgttgccgcggcgattctgaaatatgtcaatgtcattccgggtgaaacccaccgaggtgccaaacagttatacaagtttatttccagtaattttacgtttccgttgatggcgggactgggtttactatacattccgctaaaagatgttgttggcatgttgagttggcaatattttatcgtggttatcagtgtggtgctcactgtggtttccaccggtttcttcgtagcgcggttcctgaacattaatccggttgaaacggctattgtgacggcttgtcagagtgggatgggcggtactggcgacgtggctattctcagtacggcgaatcggatgaatctgatgccatttgctcaggtggcaacacgcttgggtggcgcgattaccgttattaccatgacggcgattctgcggatgatcttttaa

SEQ ID NO: 120 - DNA, 10304 bp, Lactobacilllus rhamnosus
aataggccgcggaccgatatcatcgccaccaggcagcccaacaattgctttgccaaagcgccctaataacgcgcccataaaataataggaggcgcgcagactcttaatcttaccgtttggcagcggcacatcattaatttcggttggatcagagaacgcacggggattaaaacccggcatgtggtcactgaccagcgtaactttgatttagcctatgatgtcgcccaacaattgttagaaaaatcgacggtcaccgccgatcagctcgatttcatcatcgtggcgaccatgagcccggactacgccaccccggccgaggctaatcgcctgcaagcagctttaaatgcgaatcacgcatttgcgtttaatctcaatgttgcttgcgccggttttgaatatgcgttgcatgtcgctgatcggctgatgaccagccccaccgttcatcaaggactggtgatcgggagtgaagtcctttcccggttagttgattggcatgatcggcgcacagcagttttgttcgctgatggagctggcggcgttttggttagtgatcaaggcgccccggttcaagcagttgatttaaagagtttcggtgataccgagatggtgttgttggctggggagcaagcaaatcaaagcccccttgccgatgcacaagcgcaagcgtcgccatatttcaaaatgaatgggcgcgcggtttaccagtttgccattagcgaagtacctcgctcgatcaatcgggctttggaacaagctaatctgacaacagatgacattgactggtttttgcttcatcaagcgaatgcgcgcattgttcaatcagtgaataaaaagttgaaagtcgcggaagcaaaatttccgatcaatattgatgagtatggtaacaccagcgcagccagcgtcccgattctgttggcacagttggcagaaagcggtcagttaaaacgcggccagaaaatagtgcttagcggttttggcggcggcttgtctgttggctcacttatcatgacttactaactaacggttacaattgacagaccaatgaaacggtcaaaacttaacactcaaaggagaacatataaacatgactaacgaagaagtattgcctaaggtacaaagtattattgctgaccaattggacaagaagcctgaagaagtaaccttgaccacgaacttcaagaacgatctggatgcagatagcttggacattttcgaaatcatcaatgaaatcgaagacgaattcgacgttaagatcgatactgacgaaagcatcgaaacggtttcagatttggttacgttcatcactgaaaaggctgaagcttaagacactggagaggagtgggccaatgagtccattaatggaacgtttaggcgttaaatatccgctttttcaaggcggcatggcgtgggtcgctgacggcaaattagctgcgtcggtttctgaagctggcggtcttggtatcattggctccggtcatgcacctgcttcatgggttaaggaacagatcgaagttgcaaaatcaatgaccgacaaggcattcggtgtcaacgtgatgttactgtcaccgtttgtcgaacaggtgattgatgtgattgtcgatgccaaagttgccttggtaacaaccggcgccggcgatcctagccgctatctggaacggctccagcaaaacggcactgtggtcatgccggttgtgccgtcggttgcgatggctaagcgcatggctcgtgacggcgttgatggtgtgatcgctgaaggcatggaatccggtggtcatatcggcagtatcaccacgatggccctagtgccgcaagtggtagatgccgttgatattccggtcgttgcagctggcggtattggcgatggtcgcggtgttgcggctgcgctgagtttaggtgcagttggtgtccaaatggggacccgctttttaacctcaacatcaagccgcattcatcaaaactacaaagacgctgtgattaaagcaaaagacgttgatacccttgttaccggtatgtatgtcggtcatgcagcccgcgtcttgaagaacccgatgagtcgcaattatctcaaactggaaaaagaaattgcgctttctggcaccactgattttacagcagtggaagaattaggtaatggcagtttgcgtaaagccgttttagaaggcgatcgcgaccatggatcctttatggcaggcgaaattgccggattagtgaaacgcgaagaaagcagcaaggacattgttgaagaagtcatgcagcaggcaaaagaaattgtcgccggctcgaaaatggcggctttgctcactagtcaggttgacgtgcaagcgtaacccaaacgcaggcaaggaggtaccactttttgcaatttgcttatgtgtttaacggccaaggtgccgaggtccccggaatggggattgatttttaccagaatactttgatattcaaagagattattgatcgtgccgatgccgttttggactttgacttgccagagtttttggctaatggtgattttgcggcccatccggattacctacagccggccttagttgcttatagtgtggccatgcatgaggttgcctcagcagagttgccgccggaagctgctttagccggcttgagtctgggcgaatatagcgcattaatcgcaggtggcgggttgagcttagaatcaggacttgagctcgttgcagcccgtggtaaagcgatggccgccgcgtgtcaagaacaaccaggcggcatgctggcggtgatgagcggcgatgagaccatcatcaaaacagcttgtcagcaggcagaacatgtttggccagctaattacaatggtccgaagcaaacggttttggcagggacacatgatgacttggcaacggttgaaaagtggctgacagaccaaggtgtccgcgccattcctttgcaagttgccgggggctttcatagtccgttaatggcaagtgcacaaccaccattacaagcggcactggcagcggctcatgtctttgaaccagtgattccggtcattagtacgacggcacttaagccattttcggctagcaacatccgaccggtattggcggcgcaagtagccgaaccgacgaagtttgctgccgtgatcgcacaactgaaagcacaaggcgttgatacgattgttgaattaggcccgaaaccggtgcttagtaaaatgattaaacgcattgaccgcaagatgacaacctacctgattcgtgatgcagcaagtctcaatgaggtagccgatttgaataacggagtgaaggcagattgaaactaactgataaaaccgcgatcatcaccggtgcctcacgaggtatcggtgaagcgattgccagaaattttgctcaagcaggggccaacttggtcttgaatgcacggcatgaatttccggaaactttgatcaaagaattagaagactatggccacggtgttgtgaccgtgctgggcagttgtggatgatcccacaaccggtgatcaattggttgccgctgccttggaccagtttggcagtgtggatgtgttggtcaataatgccggcattaccgacgatatgttggcgatgcgcatgaaacccgcttcttttgccaaggtcgttcaggttaacttggatggcaccttttatgttacccaaccggccttcaagaaaatgctaaaggcccgcgctggcgtcatcatcaatctggccagtgtggtcggtttgaccggtaatatcggccaagccaattatgcggcaagtaaagcaggcatcatcgggctgactaagacgctagctcgtgaaggggctatgcgtggcgtgcgcgttaatgccattgccccagggatgatcgccaccgatatgaccgctgccttgagccaatccagtcaggaccagattctggcggaaattccgttgaagcggttcggtcaacctgaagaaattgcccacacggcccgttttctggtcgaaaatgcctacataaccggtcagacagtgactgtcgccggcggattaggttaagtacatgaacggaggaatgacattgcaacgagtagtcgtaaccggaatgggtactgtgaatccgctgggccattcagtcgccgaaactgtggcgacgatggacgctggcaaggtcggcatccagccaatcaccaagtttgatgctgaaaaaaccggaatcacagtcgctggtgaagtcaaagatttcaaacccgaagaacggatgagcaaacgcctaagtaaacggatggatctgtttacccaatatggtctctatagtgccattgaagcatatgaacaatccggtctaactgaagatgcggtcgattcagatcgagtgggcgttattttcggttccgggattggtggtttgacaaccattcaggaacaagtgacgaagatgtatgtaaaaggcccggatcgcgtgagtccgctgttcgtgccggaagccatcagtaacatggtcgcagggacaatttcccattactttggtacgcatggccccagctatgttgtcgtaacggcatgtgcttcagctacgaatgcgattggcgaagcagcgatgcggattcaaaccggtaaagccgatgttgtgattacaggcggcgccgaagcttcagttaacgagatcggaatcgccggttttgctgcgctttccgcattgtccaaaaataccgatccaaccaaggccagcctgccatttgcggctgaccggaatggtttcgttttgggcgaaggtggcggtgcattgattctcgaaagcctagagcatgcacaaaaacgcggcgctaagattttaggtgaagtggttggctatggtgccaccagtgatgcctatcatatgacggcgcccgatccaagtggctctcaggcggcacgtgcgatgcaattggccgttgaagaagccggcattaagccaagtgaagtcggctacattaatgcccatgggacagcaaccaaagccaatgacgcgatggaaagtaaagccatccatgatcttttcggcgacgatgtgttggttagctcaaccaaggcattgacaggacatctgctaggtgctgctggggccatcgaagcgatcatgacgctaagtgccttacaaagcggccggttgccaatgaatgtggtggatgcggctcaagacgaggattgcccggtcacgctggttaatcgcgacaatcgtgatacatcagtcgattatgcattgagtaactcctttggctttggcggtcataatgccgttttggccttcaaaaggtggtgagtgtcatggacaccaaaatgatcgaagttttgatcaaacagttggagcaaagttcgctgcacgagctggaactgacacttggtaacgactcgctacatttggtcaaagcaagccctgctgccgcgcctgcacctgtgaccccggctccggaaaatacggcagcgacacctgtcacgccggtaccggacaagccgcaagcggatgaaggcacagcggtcaaagcgccactggtcggaatcgtttatttggctcctaaaccaggcgctgatccgtactttcaagtcggcgatcacgtaaaaaaaggtgacgttgtttgcatcatcgaatccatgaaaatgatgaatgagattaaaagtactgttagcggcacggttaaggcggttaaagtcgataacgaaagcttagttgaatacgaccagccgttgctcatcgtacaagaagacaaagcgtaaaccgagtcgcattccggctccataaacacgttttaggaggatagcattcatgctcgaaaccaaaaagacacttgaagcacaagaaattcaggcgattttgccacatcgttatcccatgttgatgattgaccgggtactggatctcaaacccggcgaatctgtggttgcacaaaagaacgtttctatcaatgaacagatttttcaagggcattttcccggtaacccgattttcccgggcgttttgcagatcgaagcgatggcgcaagcaggggcaattgctttgctttcgatgccagactttaaaggtaaaacagcttatctcggcggcattaagaaagccaagttccgtcacatggtacgccccggcgatgttttgcgcatcgaggtcactttagagaaattgatcgacaatgccggcttaggaaaaggcaaggtttacgtcggcgaagatatggcttgcagtgccgaacttgtctttgcaattggttaaatcgacccgattcagactcgtgtaaggaagtggaactgtgttcaaaaaagtactcgttgccaaccgtggcgagattgcggtccgtatcattcaaacgttgcgggaaatgggcatcacctcggtggcggtgttttcgaacgccgatcgccacagcctacatgtcttgctggcggatgaagcgatttgtatcggtggtccgcgggcaactgattcttatctgaatatgcgcaatgtcgtgagtgccgccattttaagcggtgcggaggcggtgcacccgggttttggtttcttatccgaaaatgccgaatttgccaagttggtgactgatgccgggttagccttcatcgggcccaagccgactgccattgagcaaatgggtgataaagccgttgcccgtcaaacgatgattgatattggtgtgccggtgatccctggcagccggccgcttcaggatgtcgatacagcattggcggctgcacaggcgattggctatccgctgatgcttaaagccagtgctggcggtggcggtaaaggtattcgtaaattggcgagtgccgatgacctgacagccgaatttgccggtgcgcaggcagaagcccaagctgcattcggtgatcccaccatgtacctggaaaaggtgattgtcccggctaaacacgttgaggttcaagtattgcgcgatcagcaagggcacgtgagcgtttttcccgagcgtgattgcagcctgcaacgtcacagtcagaaaatgatcgaagaaagtccctgcccggtgttaacgtcaccggaacgggctaagctgttgcatttagccgaaacgattgctgacggcgttgattacctcaatgccggaacgattgaattcttaatggatcagcagcatcatttttatttcatggagatgaatacgcggattcaggttgaacatccgatcacggaaatggtgaccggcgtggatttggttcaggcacaattgcgcattgcggcaggcgaagacgtggagttgaccacgccggaaccttcaggcgttgcaattgaatgccgactcaatgccgaagatccggatcatcagtttatgcccgatgtcgggacgctggaacaattacgttttccgactggcggactgggtttgcgcgtcgataccggcgtggcgccaggcgataaaatcagcccgtactatgatgcgatgattgccaagattatcgttcatggccaaacgcgtcagtcggccttggctaaaatgcaccgagccctgacagagttagacgttcaaggtgtcaaaaccaaccgcgactttgcactggcacttttccaggcacccaaggtattggctggagaagctgatacggcttatctcaaccgtgactttttgcccacaatggcaggatgaaaggaaggatgctgcatgttccaaccacaactaacccaagaagcacttgctcgtgaggcggctttgcctgaaaacctatggattcaatgtccatactgcaagcaaggcagttatcgtgaaagtctcggcgatgcccaagtttgcccgcattgccattatggatttcgcatcacggccaaaaaacggttagccctggtagcgacagatgcaacggaatgggatgcggatttaaccacgaccgacccgctggattttccgggttacgagaagaaactagccgcgggacgtcaggcgtctggtttaaaagacagcgtttggaccggtcaggcgaaaatcggcggacaggtatgcggtcttggcattatggatcctaagtttatgatggggtcactcggaaccgtgactggcgaacggaccacgcgtttgtttgaaaaagcaaccgaagcaaatctgccagtcgttttatactgcgcaagtggcggtgcacggatgcaagaaggcattcattcactgatgcaaatggccaaggtcagtgcagcagtcaagaatcacagcaatgccggcttattgttcatcagcgtgctcaccgatccaaccatgggcggcgtcacagccagctttgccatgcaaggcgatatcacactggcagaaccccacagcctcatcggattcgccggccgccgcgtcatcgaacaaaccatcaaccaaaaactcccgcaaaacttccaacgcgccgaaaccgtcctccaaagcggcttcatcgacgccatcgtgaagagaagcgaacaagcggattatatcggggaactgttacaaatgcacagagcgtgaacaggcccgcttagaaaccggagcgtaagtggccctgagcctaaatggccggtctttggccatttaggctcagggtccttacgtgcaggtttctgggcctgtgaacgcgtttcagcatcggagaatgtccccaaccgaaacaaaagtgatttcccgagccagccggtctttggccatataggctagaggcccatacacgcagatttctgtaactgtgaacgcatttcagcatcggaaaacatccccaccagcaccaacacgaagcaaggaggtaccctggcatgcccaaaaaagaaacatccgcctacgccaccgttcaagcggcgcgcgcaccccgtccctataccacccgcgaactcatcaatggcttagtcaccaattttcatgagttacatggcgaccggtccagtcatgatgatccagctgtcattggcggcatcggttggttggatgaccaagcggcaactgtgattgcgaccgataaaggcaatgacttgacagaacggttgcagacccattttggcagtccggagccttggggttatcgcaaggcgttgcggcttatgaaacaggcggcgaagtttcatcgtccgattgtcacgctgattaatacacccggtgcctatccaggtaaagaagcagaggcaaatgggcaaggggcagcgattgcagacttgctcgtcacgtgcgccgatttaccgacaccgattctggcagtattggttggtgaaggcggatcaggcggggcactggcgctggcgtttggtgatgaagtctggatgacagataaaagcatgtacagcatcttgtcaccagaaggctttgcagcgattttgtggaaagattccagccgtgccaaagaagcagctgaagtcatgcaactgaccccgcgggatttgttggctaaaaaagtctgtgatcggataattacggataccggtaccgacttccccagcgcactcaaagccgaggttaagccaaagttggcgacccttatggcattggatccgcagacactggttacccagcgtcaagcccgcttccgaaatttttaatgaaagcggcaacacaccgtccatttcattggcggtgttttttctttggtcaaaaagcttgcaccggaagttatccatcatggttccttaaatatcgggtggtcagccatcttcaagcttaaatagctggcgatgtcggtggatacctgcaccccttccggcgcggtattggcaaggaagccaaatgccagcggaaagaccacaaagtaggcgaatgccatgccgatataaaacagcagagagctggaaaccagcagcggcaccaccaggcgacgttcatgcttatacagcgctggggcgataaatgcccacacctgatagagaatcaccggcgctgacagaatcagcgacaccataaaggtcagcttgatcggcgtaaagaacggcaggccacgtcggaggcgatcatcggtgaaccttgcggcaactgcttgatcaatggcgcggataccaggtgatagatgtcattggcgaaatagaccagacacaggaatatcacgatcaccgcgataatggcagttcagcagacgctcacgcggctcaatcagatgcgtgataagcgggtgagtatcttctacagacatgtttacggtttatcactcgacgaaagggaaggtgcactggttttggttcagcggccgcagcaggttataccaccggttctgcggggtttctggattctgtccggaaactgacctgcgttggcagagtaggcgtacgcctcatgccgttaatatctttacaccggtatggtgggtgcctatcgtgcttttagacgatgcacaagacgttatactcgggctgctaatatctgactttattggcgagtatggccgcttc

SEQ ID NO: 121 - DNA, 1716 bp, Lactobacilllus rhamnosus
  misc_feature (1)...(1716): n = A,T,C or G
caagtaaagcaaggcaattgcggcgtacatgcaacatgcaccgagtcggacgtggctgttaccagacgtcggttccacaaactcgattttaactggggcaacccgttagaataaacctttatttcctaaaggaggaaattttagcatgactgttaagattggtattaatggttttggccgtatcggtcgtttggcattccgtcgtatttacgaattgggtgcaaagagcaatgacattcaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagctgctgctaacacgattcctcacagcactggtgctgctaaggctatcggtttggttatcccagaattgaacggcaagttacagggtcatgcacagcgtgtttctgttgttgacggttccttgactgaattggtttccatcttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgatggtaagcttaattgaaacatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcgggcaaggcaattctgctgtcttacccttggccgggttaaaaccgaagaagataagggcaaagctgacccttgaagccctgtttgcagaaacgccctttagaggaatttgcctggaaaaaagccccanttaccttnttgttaccccgacttaccccgcgggttaaaagaaatttgggaaagaaccccgcatccggcaaagtttaaaaaggacg

SEQ ID NO: 122 - protein, 227 aa, Lactobacillus rhamnosus
MSTHIDAPKGAIADVVLLPGDPLRAQYIAEHFLEKAVRYNTVRNAFGYTGTFEGRRISVQATGMGIPSISIYVNELIQDYGVKTLIRVGTAGGMGSDVKVRDVILVQGSSTDSSIVLNTFGAGMYFAPIADFQLLREAANLADAGALRYHVGNVLGEDRFYNDEMDRQKLIDYGVLATEMETPALYLLAAKFHAQALSILTVSNHLITGEETTAQERQTSFNDMILK

SEQ ID NO: 123 - protein, 371 aa, Lactobacillus rhamnosus
MIDVVTSPATIGIIGGGQLGRMLTQSAKTMGYRVGILEPTPNSPAGQVADFQITAPYDDQAALTKLAKESDVLTYEFENVDLAALEAVRDLTRIPQGTAILATTRDRIKEKTFLQTHGVPVTPFAAVDRPEALTAAIEKIGLPSILKTTTGGYDGHGQQDINTMADVPAAEQLLAHGPCILEKRQQFDREASVMITRDGRDQVRVFPIVENRHKNHVLHLTLAPAPNISPVLAEKIDDLATKITLGLDLRGVLGVELFLEGDNVVANELAPRPHNSGHYSIEACNFSQFDAHILSICGLPIPQITLKQPAVMRNLLGDDLTQAKAKWPQHPEWHMHDYGKAEIRPGRKMGHITVTDARDVMDILKQMEAAW

SEQ ID NO: 124 - protein, 484 aa, Lactobacillus rhamnosus
MFVADTKKQLRWYNVALIAFVSVWGLGNVFNNYAQQGLSVVTSWILIMLIYFVPYALIVGQLGSTFKDQAGGVSSWIKETGSVRLAYYAAWTYWVVHIPYLAQKPQAILIALSWLFKGNGDFVNTVSSMTVSLICLALFLLFLWLSSRGLTTLNRIGSMAGTAMFLMSILFIILAVTAPLMVKGVHVATPNMGDIHTYLPKFDLNYFTTISMLVFAVGGAEKISPYVNNTKHASKEFPLGMLVLAGMVAFCALLGSFGMGMLFNSHHIPTDLMANGPYTAFAMLGKYYHVGGLFVILYSIANALASISALAFSIDAPLKILLSDADPHFIPKKLRRINRKGTPINGYWMTGILVSLLIIIPAFGIGNMNELYKWLLNLNSVVMPLRYLWVFLAYYLLNQHLEKFQADYMLVKNKRLGMLVGRWCFFFTAFACLLGMLPKISYLNDPGTWWFQMGLNIITPVILLALGLILPVIARLHENDLDAQ

SEQ ID NO: 125 - protein, 272 aa, Lactobacillus rhamnosus
MQELEKYSLDDTYIRPFDREKQEIALETKDLHVFYGDNEAIHGVSLPFERYKITALIGSSGSGKSTYLRSLNRMNDNIESARVTGKIMYRNIDINSDAVDVYEMRKHIGMVFQRPNPFAKSIYDNIAFALRRFGIKEKKKLDEIVETSLKQAALWDQVKDDLNQSGMSLSGGQAQRLCIARAIAMKPDILLLDEPASALDPISTSAVEDTLLSLKDKYTIIIVTHNMQQAARISDYTAFFYSGAALEYDETRKIFTRPKIKATNDYVSGHFG

SEQ ID NO: 126 - protein, 254 aa, Lactobacillus rhamnosus
MAEAQKIITSSDVHLFYGKFEALKGINLDFNEHEITALIGPSGCGKSTYLRTLNRMNDLIPGVTITGTISLRGQNIYAPSEDVVQLRKQVGMVFQQPNPFPFSIYENVIYGLRLAGVKDKSILDEAVETSLKQAAIWDEVKDHLHDSALSLSGGQQQRVCIARVLAVKPDVVLLDEPTSALDPISSTQIENMLLELRDQYTIILVTHSMHQASRISDKTAFFLTGNLIEFADTKQMFLNPKEKETEDYITGRFG

SEQ ID NO: 127 - protein, 300 aa, Lactobacillus rhamnosus
MLKKSRSSKLERRGKTISLICISLIVLVVVAIFFFVASKGLATFFQNKINLWSFLSKSVWNPSIKDAHGNPEVGALPMIVGSFGVTFLSAIVATPFAVGAGIFMTEISHKWGQKVLQPVIELLVGIPSVVYGFIGLSVIVPFIRHIFGGTGFGILAGTFVLFVMILPTVTSMTVDALKAVPRHYREASLALGATRWQTTYRVVLRAAIPGILTGIVFGMARAFGEALAVQMVIGNAALLPKNLVSPASTLTSVLTSGIGNTVMGSLENNALWSLALLLLLMSLAFNLLIRWIGKKGELNK

SEQ ID NO: 128 - protein, 234 aa, Lactobacillus rhamnosus
MKKILIVDDEPAILTLLQYNLEAEHYQVETATDGQEALDKVRSEPFDFIILDLMLPSLSGLDVTCKIREEKIQTPIMILTAKDNETDKIVGLELGADDYVTKPFSPREIIARIKAIERRSQSQPQAPLSRNANQITVGQITIDPENYKASKAGHRLQLTPKEFELLVYFAQRVGKTLSRDALLNGVWGFDYPAETRMVDIQVSHLRDKIETDPKHPDYLKTVRGFGYQMEAPHE

SEQ ID NO: 129 - protein, 250 aa, Lactobacillus rhamnosus
  VARIANT (1)...(250): Xaa = Any Amino Acid
MLLSGFLVKMALLTNSWNLSELVHNSCXILNLLDYHLSKEGFSTQLVTNGRKALALAETEPFDFILLDIMLPQLDGMEVCKRLRAKGVKTPIMMVSAKSDEFDKVLALELGADDYLTKPFSPRELLARVKAVLRRTKGEQEGDDSDNIADDSWLFGTLKVYPERHEVYKANKLLSLTPKEFELLLYLMKHPNMTLTRERLLERIWGYDFGQETRLVDVHIGKLREKIEDNPKAPQFIRTIRGYGYKFKEL

SEQ ID NO: 130 - protein, 269 aa, Lactobacillus rhamnosus
MQSTYGTRFLRVFVKNSRFNFGTMDSDVTVPNDCRVNGVKIMKILIVDDDKEIVELLSIYVKNEGYEPIQAYSGKEAITKLVTNPDIALMILDIMMPNMSGMDVVKEVRKDSQIPIIIVSAKTADMDKIQGLITGADDYVTKPFNPLEVMARVKSLLRRSQNEVTNSEPDVLEVGPLTIKKDSHEVTTLTGKQIQLTALEFGILYLLASHPNRVFSADEIFERVWQQESIVSAKTVMVHVSHLRDKIEEATDGEKVIETVWGVGYKVEA

SEQ ID NO: 131 - protein, 224 aa, Lactobacillus rhamnosus
VFKIMIVEDDQTISGLIADNLKKWQFEPVVVTDFNAVFDDFLQEKPHLVLLDINLPVFDGYYWVQKIREVSKVPVIFISSRNTNMDMVMAMNMGADDFLNKPFAMEVLIAKINALLRRTYNYADQGTDVLEHNGLMLNLKNGMAQIGEKEINLSKNEYKLLQILMRQHGQIVSRSRLLRDLWQDERFVDDNTLTVNVNRLRKKIEEAGLKDYIQTKVGQGYIVP

SEQ ID NO: 132 - protein, 246 aa, Lactobacillus rhamnosus
MNHNRYKCGANRLGAMEGEGMQTKVLAVDDDAAILAMLKRYFAWRLPEFRLLTADAGQAALSQLAQQPDLILLDVNLPDIDGFTLTSRIRAITSVPIIFLTARITDQDKVQGLGAGGDDYVTKPFSLTELGARIKAHVRRAHQPDKQAQIAVFGRIMIDYHAHQVSVDTTCLKLENKQYQLIEWLSLNPGQVFSREQLYEKIWGYDAQGDERVITEHIRRIRKLFDACQVTSPIVTVWGVGYKWQN

SEQ ID NO: 133 - protein, 258 aa, Lactobacillus rhamnosus
MTNMSGISILFSKQRPIDPQRKTRLTRTKKERLTLVKILVVEDDRNFNDLIATILRQNGYTVQGAENPPAAYDLLQSEQFDLVLSDIMMPQVDGYQFAQELRRTDPSIPILFITARDDIASKEKGFNSGIDDYMVKPINFNELLLRIKALLRRAKITADNLLIVGNLTLNNEAITAQVNHQTVDVTVREFQILYKLLSYPDHAFSRAELINEFWDLASDTSMRAVDVYITKLREKFKAADGFTIKTIHGLGYKAVLTL

SEQ ID NO: 134 - protein, 422 aa, Lactobacillus rhamnosus
MKKQAIRMARGDYSGQVRVYGQDELGQLAVAVNNLSVRVEEAQEASEAERRRLDSVLAHMTDGVIATDRRGNVIIINQTALSFLNTKNEDVIGVSILKLLNIAKDYTLRDLLEHQTELLLDFSEQLDHDLILRVDFSLIQRETGFISGLVAVLHDVTEQQKIDRDRKEFVSNVSHELRTPLTSVRSYIEALSDGAWKDSKLAPQFLNVTQEETDRMIRMINDLLSLSRLDSGTSKFNLETVNLNEFFNYVLDRFDMMLKTDNEHTGEARTAQPLPQPDGQKKRYSIKREITHEDLWVEIDTDKFMQVIDNIMNNAIKYSPDGGVITARLFQMHDHVILSISDQGLGIPRQDLGKIFDRFYRVDKARSRKQGGTGLGLAISKEVVEALHGRIWVDSQEGRGSTFYISLPYEPITDGGDDWDEA

SEQ ID NO: 135 - protein, 422 aa, Lactobacillus rhamnosus
MALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 136 - protein, 675 aa, Lactobacillus rhamnosus
MQVLSRVWQSIRWFFRRFQVIRWLILLGLTVILIFSAWFTYKAKTADVQNIKSTLQTKTVIYDANNEEAGTLYGQKGTYVELSAISPQVQNAVISTEDRTFYSNGGFSIKGILRSALNYVIHHGQIMGGGSTITQQLAKNTLLTQKQTMLRKAQELFMAIQLNKVYSKQDILAMYLNNAYFGNGVWGVQDAAKRYFGKNASQLDASEGAILAGMLRNPSYYNPADHKDNAISRRNVVLQLMVDNHKLTQAQANAAKAQSVQVVDAFSNANAQKYPSYFDSVIEEARSEGISVDDILNKGYKIYTNLDQTYQQNLQTSFEQDWAFPANAADGKQVQGASIILDPKTGGVRAVVGNRGEHTFLGFNYATQLRNSPGSTIKPLMVYTPALENGYHYDSILKDEKLSYGKNNYTPTNATGTYLGTVPMYQALADSINAPAVWLLNKLGVQKGVASLDRFGIQLKSSDQNLAAALGGLKNGVSPLMLARAYAAFANDGKLPTTHFIRKIVDASGETVVDNSHPATRQIMSKKVAQEMTSMMIGTFNEGTGKTAKPSGYTIAGKTGSTEVPSSWGYGTKDQWVVGYTPDIVNATWIGYPTTDSQHFLQGTSTSGVAPLFKLEMSKLMPNTPQTAFDTKDAAQMASIQTPGKSDDTWQGIPYSIDRGIVSAKQSVAQWYDTI

SEQ ID NO: 137 - protein, 771 aa, Lactobacillus rhamnosus
MYVANNQNMSRMARRREGKQSKSPKPPKKLWRRILKWTLLGLLLIFIAGVGLFSWYAKDAPEVTQAKLESGGSSTIYDRSGNEITTLGLENRDYVKASEIPQQLKDAVVSIEDRRFYDEKLGIDPVRILGAAFNNMTGTGDGLQGGSTLTQQLIKLSVFSTKSSDQTLRRKAQEAWLAMQVQQKYSKDQILEYYINKVFMNYGQYGMSTGAKFYFNKSLKDLSLAQTAFIAGLPQSPAGYDPYEYPQKATQRRNAVIDAMLRDKKITAAAAKQAKATPITDGLQPKQQQTNTTTNDKVIDSYLTQVIAEVKKKTGLNPYTDNLDIYTNIDMSAQKRLYDIVNTDDYVSFPDDAFQTGVTMTDPDNGQVLAQIGGRKTGDVRLAYNRAAQNTRSNGSTMKPLMDYGPAIEYLNYSTYEQMTDEPYKYPGTTISLYDWDKKYQGRISMRTALEQSRNIPAVKTLSAVGMTNAVKFLKGLGIDLPASEQYLSSAIGASVNTVEEAGAYGAFANGGTYYKPYYVNKVVSADGNTQTFNSQGTRAMKSSTAYMITDMLKGVLTKGTGTSAAISGLYQAGKTGTTDYSDEELKQNPALNATGIAKDAWFTGYTRNRVISVWTGYDKPTSHGISYAEQTISQKIYKALMSYTSQNLDNKDWTKPDTVESYNILKGSNPGTAITSGSANTTKELYVRGHGPSSHKAVAESSSSSSASSESSSSKESSSESSNAVSASIASHATSSSVSSTAPSSAAPSKEETSSSSEPVSSAGGPGGNQ

SEQ ID NO: 138 - protein, 660 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSDQAGTAHDLAIDGHTIAAKTGTGAELKQKQDTDGKENGFLVAMDADKNTYLTVALIEGTGSGDVVTGNEAFCG

SEQ ID NO: 139 - protein, 306 aa, Lactobacillus rhamnosus
VGTQERGERLSSLAEFFTALGKYDFLQSALITAIMVGIMSGLIGSFIILRGMSLMGDAISHAVLPGVAVAYMLGVNVMIGASVFGIIAALLIGFVAANSKIKTDTSIGVVFSAFYALGFILISMAESATNLHHILFGNILAVSDSDIMTTAVVLGIVILFVVLFYKELLITSFDNTFAKTYGLNTTAIHYALMLVLTLVTVSALQTVGIILVVAMLITPAATAFLWTDRLETMLVMAASVGVISSITGLYFSFTFNWASGPAIVLVAAVLFAISFVFSPKQAFFSFSKRQRTKTAATTQTAEEVIR

SEQ ID NO: 140 - protein, 458 aa, Lactobacillus rhamnosus
MDPKKLATTEYYQHRFRNFSTMIIMPSTILFLGLLLFLIFARREVTVLTAAEIEPVKAAVTVQATAANRIVSNRMKEGKRVKKGETLLVYHDVANPTQIKLLKQQLATLKEQQQQLDVLKQSVTENKDLFSKADRFGYQQQVQDYLSQRRVLTLTAEAEQATQTVASEKNKEIDRLLSASIQTSQAKMAAISEAKAAIQANKPLPSRHAYHYLYQQYESEIKNTDAEAQANLKRQYLAQLQTQLDEEQTNLTSLEQQRAGQKQADVSAQKAGETQANLTALQSRLQQTAVAEQTKVQQQVQADEAKLATLNDETQNYHVKASASGVLHLETALAGNQYVPSGSVLARILPDLTEQTVADIKLGVSPTEIMSIKRGQKVRLRIAENVPTPTILDGRVYAIDVAPTRDPKVGNFFTVKARVKLSKSQRQSLYYGLAGQASVITGTKTYWDYFADKMFNHR

SEQ ID NO: 141 - protein, 340 aa, Lactobacillus rhamnosus
MTVKIGINGFGRIGRLAFRRIYEIGAKSNDIQVVAINDLTSPTMLAHLLKYDSTHGTFPGEVSATDNGIVVDGKEYRVYAEPQAQNIPWVKNDGVDYVLECTGFYTSAEKSQAHLDAGAKRVLISAPAGKIKTIVYNVNDDTLNADDKIVSAGSCTTNCLAPMAYFLNQEFGIEVGTMTTVHAYTSTQMLLDGPVRGGNLRAARSAAANTIPHSTGAAKAIGLVIPELNGKLQGHAQRVSVVDGSLTELVSILKTKNVTADQVNEAIKKHTENNPSFGWNEDEIVSSDVIGTTYGSIFDPTQTEVTTAGDYQLVKTVAWYDNEYGFTCQMIRTLLKFATL

SEQ ID NO: 142 - protein, 88 aa, Lactobacillus rhamnosus
MEKREFNIIAETGIHARPATLLVQAASKFNSDINLEYKGKSVNLKSIMGVMSLGVGQGADVTISAEGADEADAIAAITDTMKKEGLAE

SEQ ID NO: 143 - protein, 101 aa, Lactobacillus rhamnosus
MKINHPGTAGTLESSDIQITLAPAADGITIQLQSSVEKQFGEQIRAVIKATLAKLAIENVAVEANDKGALDCTIKARTIAAAYRAADNKTFDWEEINAWIN

SEQ ID NO: 144 - protein, 292 aa, Lactobacillus rhamnosus
MDKLRRTMMFVPGANPGMLRDAPIYGADAIMFDLEDAVSLKEKDTARMLVYSALKTFDYSSVETVVRVNALDAGGDQDVEAMVLGGINVIRLPKTETAQDIMDVDAVITAVEAKYGIKNGTTHMMAAIESAEGVLNAREIAQASPRMIGIALGAEDYLTSQHTHRSADGAELSFARNFILHAAREAGISAIDTVYTQVDNEEGLRHETELIKQLGFDGKSVINPRQIPVINSVFAPALAEVQKAREIVAGLKEAEAKGAGVVSVNGQMVDKPVVERAQYTIALAKASGMEVD

SEQ ID NO: 145 - protein, 510 aa, Lactobacillus rhamnosus
MVKNKLNREIPEPFADQYGVFGGEFANIQPYDEHARHIKPVKPDHSKLVASIHDAIVATGLKDGMTISFHHHFREGDYVMNMVLAEIAKMGIKNLSIAPSSIANVHEPLIEHIKNGVVTNITSSGLRDKVGAAISSGIMQNPVVIRSHGGRARAIARGDIHIDVAFLGAPSSDEYGNINGTKGKATCGSLGYAMIDAKYADQVVAITDSLMPYPNTPISIPQTDVDYVVQVDAIGDPTGIAKGATRFTKNPKELKIAEYAAEVITKSAYFKDGFSFQTGTGGSSLAVARFLREAMLQQNIKASFALGGITNSMVELLKEGLVEKVIDVQDFDHPSAVSLGENADHYEIDANMYASPLSKGAVINQLDIAILSALEIDTDFNVNVITGSDGVIRGASGGHSDTSAACKMSMVIAPLVRGRIPTIVENVNTVVTPGASVDVVVTEVGVAINPARPDLIEMFKDLKVPQFSIEALKNMAYQITGTPAAIQYGDKVVALIEYRDGTLIDVVHNV

SEQ ID NO: 146 - protein, 407 aa, Lactobacillus rhamnosus
  VARIANT (1)...(407): Xaa = Any Amino Acid
VGQIILAGAMQQLPVNMLGGFAVILTMGWLLGTIGANIPVVKNFGGPAILSLLVPSILVFYNALNPNVLKATDMLMKQANFLYFYIACLVCGSILGMNRKILIQGLMRMIIPMMLGMILAMGVGTLVGVLLGLEWKHTLFFIVTPVLAGGIGEGILPLSLGYSTITGTTSGALVAQLIPATIIGNFFAIMCSGLLNRLGEKRPELSGAGTVGSTEWGRRXTWQTRKTIRGPLDLKMMGAGVFTACTLFIIGMLLQSVPGFPGPVLMIVAAAILKYVNVIPGETHRGAKQLYKFISSNFTFPLMAGLGLLYIPLKDVVGMLSWQYFIVVISVVLTVVSTGFFVARFLNINPVETAIVTACQSGMGGTGDVAILSTANRMNLMPFAQVATRLGGAITVITMTAILRMIF

SEQ ID NO: 147 - protein, 317 aa, Lactobacillus rhamnosus
MTSGGDQVNIGIFTDSYFPQVSGVATSIKTLKDDLERKGHQVYIFTTTDPHVPDDAVEPNLFRFTSVPFVSFTDRRIAVRGLFHAYAVAKELNLDIVHTQTEFSMGYIGKFVAKQLKIPTIHTYHTMYEDYLHYVLNGHLLKPYHVKQFTRAFLYHVSGVIAPSERVYDTLRRYGVKTDIKIIPTGVDLTQFAEQKDPHLREKLGLADVPVLVSLSRVAYEKRIDKLISAMPAILAQIPKAVLLIVGDGPAREDLEAQAAELGIADHVRFTGEIDHDDVGDYYRVGDVFVSASDSESQGLTYIEAMAADRKSCCPCW

SEQ ID NO: 148 - protein, 560 aa, Lactobacillus rhamnosus
MHKSWWQEAVVYQVYPRSFQDSNGDGIGDLQGIIQHLDYIKELGADVIWLNPIYKSPNADNGYDIADYQQIMPEFGTMTDFQQLLKAAHARGLKMMMDLVVNHTSDEHPWFQAAKQSRTDPHHDWYIWRDPVDGHEPTNWRADFGGSAWTYVPEVGQYYLHLFAVKQPDLNWTNPAVRKAVFDMMTWWCDQRIDGFRMDVINLISKPDVFADDPHLLEQPNGNSLGLIANGPHVHEYLRAMNKAVLSKHDLMTVGEAPGVTPALALQYTGFDRHELEMVFQFKHVGLDNDPQFGKWSLKHPQLTDLKRVLSDWQTALHGKAWNSLYWDNHDQARAVSRFGDDRPAFRVHSAKMLAATLHFLEGTPYIYQGEELGMTNVAFPSIHDYRDLDTLNAWHELVEQQHALAPEDMLKRIHRRSRDNARTPMQWSPAPQAGFTAGTPWLAVNPNYTDINATAALADSDSVFFFYQKLIRLRKQYPDLIVYGAYTLLDPDDPDVYMYQRHAAKQELLVISNFTDQTLTRDIAKQLSPSAKLLISNYDDDAENTLRPYETKAYLTSER

SEQ ID NO: 149 - protein, 319 aa, Lactobacillus rhamnosus
MALISLEHVTKTYDDKPVVNDLSLQVDQGELFVLVGTSGSGKTTTLKMINRLVDPTAGVIKFAGKPLMAYKVRDLRWNLGYVLQQIALFPTMTVAQNIAVIPEMKGWSRQKIRTATDDLLAMVDLPPAEYRDRMPSELSGGQQQRIGILRALASRPKVVLMDEPFSALDPISRTQLQDMLLHLHRAMKTTVVFVTHDMAEAMKLGNRIGVMHNGRLLQVDTPEAIATQPANDFVADLFKGAQANQGLQVTLSQLAPFAVEQSADHAVGGNLTLAEALPLLDAHETLRVKSDHGVFVIDTHSVVAYLASAFVDQDTETKG

SEQ ID NO: 150 - protein, 307 aa, Lactobacillus rhamnosus
MKKRQTVKNIGEVINNLRERKGMSQADLSTGILSKAQLSKFERNLTQISATKLLALLERLHVTFAEFGNALAFQEALYEQSILADITKAVVNNNRDQAELVRERAAEHFTAFPGKYNQLILIMVNAMIADMTGETLSQADIDVLTDYLFHVDGWTRFELLLFGNTISALPLRTVNQLARELAAQVNVAWEIHQNFQLIINLLYNVVIVNLSARDLTTARHYLRVMKDSHVEDGMMAERFLIALAEALCIYCEDGTAAHKDQVEKIIAIQKELGATNFFIAFKNQAEMFINETKQTDAFPAGWQSYIF

SEQ ID NO: 151 - protein, 259 aa, Lactobacillus rhamnosus
MSWSIKKVFNRHKEDQETQKNGVMLVAFAEPKHVVSEQFRTVRTNIEFAGAALDKCQVVMFTSSAMSEGKSTVSANVAVTWAQAGKKVLLIDADLRRPTVHATFRKLNLDGVTTILTGKNKPEEVVEDTFVDNLSMISSGPVPPNPSELLNSKRMGELLEWARSNFDIIVLDAPPVLAVSDVQVLVPKTDGVVVVANIGKTLKGDLRRTVKVLKLAQAKILGSVDGVKAKHGDRGYGYGYGYGLRLPEPEVRKSSFYRT

SEQ ID NO: 152 - protein, 331 aa, Lactobacillus rhamnosus
MLMSDMPLVSIIVPIYNVEKYLQRCIDSLFAQTYVNIEIVLVDDGSADRSLSICKKNAQQDERVRVFSKTNGGVADTRNFGVSVARGQWISFVDPDDYVDPDYIEYLYGILVKSNATMSICQHRNVYKNGKIQTNLYEGPAVLDSHTAVKRLLYDDQIDTSVWAKLYPAWVFKKIHFPKGRLFEDIAATYKTFLASDSIAVGSEAKYSYPFRYNSIVNDQFSLHKLDLIDMTEQMACEVKKVYPDLQIASQRRVLYAYISTLNQMQNVDGYQEIREQLISKIKELRKPVLEDHKAPIRDKVAICLIGFSYPIYRKAWKIYLKIKKGEEVSA

SEQ ID NO: 153 - protein, 479 aa, Lactobacillus rhamnosus
MKWIITKIVKNLLWNMGYQIFILLLPIVTIPYVSRVLGPTGIGINAFTNSIVQYFVLFGTLGLTMYGNREVAYQRDNPKRLSGLFWELTLLRLVTTGIATLLYLGFILLSGEYQVFYLIQGLLLVATAIDVSWLFQGLEEFRITVLRNTLVKIISLILIFVLVRTKNDLWLYILILTGSQVLGNLTLVPYLKKYVVVPHWYDLKVIDHLRPTIEMFVPQIATQVYLQVNKTMLGALVGVQASGFYDNSDKIVKILLAVVTATGTVLLPHTAHSFAQGKHDEVEASLNKSMHFILVIAFPMTTGLAGIAPIFTKIFFGKGFDPVANLLVIESIVIVLIGISNATGVQYLLPTNQLRPFTTSVVFGAVANMVLNVPFILIWGSNGAMIATVLSELLVSIYQLSKVRNQLRIRSLFSEVWKYLVAALLMGVSVRVFINVLPLSNFLALLGATMYGALIYTLALVILRPKILLQMISSLRGLR

SEQ ID NO: 154 - protein, 341 aa, Lactobacillus rhamnosus
MVELQSVKDESPLSRALQDEHYNGAVAVVSPDKELAADSQGFSHIDMAVPFASHTVSGAGTVTQQFFGILLMQFVEKGVVKLSDKLSQYVPEYHNADQITLHQLANMQSGIPDYLTLMAKPFKENAPATLPDERLALQIDQHNATNMDFAKVLDVVNDVPLAFKPGSQTSYSSTNAILIGEVLDRLTNERPLEAVLKEYIYDPLALTNTKLGTAHAFAEGYHWIAGNPNIAGKGDENQADRGLVTTVDDLEKFAQAVLTGKLLQSTSWKTIFKDAENGYGFGWHKLENGWLGNSGSMLGYTGLLSINQKQKKAVVGLTNVLKPQPAMDQFFNTIYQVATTL

SEQ ID NO: 155 - protein, 709 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSDHPIDIQVLGIGRNGHIGFNEPGSPFDAETRKVPLTQSTIDANARFFENENDVPRYAYSMGIGSIMKSKKILLLAFGENKADAVQKMIEGPVTNDVPASILQKHPDVVVILDKAAASKLSHK

SEQ ID NO: 156 - protein, 64 aa, Lactobacillus rhamnosus
TDVAATSEADVVFHNGLNLETGGNGWFKKLVKTSHKEFDKDVFAASKGVTAQHLTTNTKEQDPL

SEQ ID NO: 157 - protein, 312 aa, Lactobacillus rhamnosus
DNMTTLIFGHQNPDTDAITSAMSWAEFQKQAGNTDVEAVALGEPNDETKFVLDHFKVAAPRVIKTAANETGHVMLVDHNEFQQSVADIEDVQIDSVVDHHRIANFHTASPLYYRAEPVGSTNTVIFELFQEHGYEISPTLAGLMASGLISDTLLLKSPTATDKDKKILPEMAKIAGIDLQSYGLAMLKAGTNLAAKSDMDIIEGDAKSFTMGGKSIRIGQVNTVDLDDIYARQDELVAAMTKEAQAKGYDDFLLIATDILNSNSAGFAVGADRDKVAAAFNEKFDANDRLALPGVVSRKKQVVPPMQGAFEG

SEQ ID NO: 158 - protein, 161 aa, Lactobacillus rhamnosus
KGAVIKIIDKIEKTSVSGTKTWRDNNNQDGIRPSSITVNSLANGQQVASKKVTASDNWQYSFDNLAAYANGQKITYTVTEDAVAGYTSTVDGYNITNTHNPTTPKKPQVPNNPTTPKEPQVPNNGNKVTPKDFTQGKMYDKTSRLPQTGDGSSMGMMLIGL

SEQ ID NO: 159 - protein, 101 aa, Lactobacillus rhamnosus
MKQILTWLVRGYQRFISPLFPPSCRYYPTCSTYMIQALQRHGAVKGFLMGIARILRCNPFVKGGLDPVPAYFTLRRNPHPENDLDLSDIQNLNRKLGGHHG

SEQ ID NO: 160 - protein, 98 aa, Lactobacillus rhamnosus
RIPDHTAVKAPYVRLITTEKGPNGDEISNYDLRLVQPNTAAIDTAGLHTIEHLLASLLRDRMDGVIDCSPFGCRTGFHFDYLGNTQHHGSRQSAEVQP

SEQ ID NO: 161 - protein, 214 aa, Lactobacillus rhamnosus
VRLLAKKRRRFTLKKVPLAAWLVIAFFAVGSMLVVSSYWSQRQAEVSQRQAIVDKKAAEKAKKEAFIKRLVPTAQAMQKQYGVLTSITLAQAILESDWGTSTLAKDYHNLFGIKGTDPATTKVLRTKEYVNDKWITVDGRFRVYSDDAASIRDHALLFVNGTDWNPQQYATVRAAKDYKTAASALQTDGYATDPDYPQKLIHLIEAWNLTQYDN

SEQ ID NO: 162 - protein, 276 aa, Lactobacillus rhamnosus
MTKVKKERVDVLLVEQGLFESREQAKRSVMAGEVYDQNNQRLDKPGVKIPGDAILHVKGKKMPYVSRGGLKLAKALKVFAIDLTGKTVLDIGASTGGFTDVALQNGAKMSYALDVGYNQLAWKLREDPRVKVMERVNFRYSKPEDFTDGPVEFAMTDVSFISLKLILPPLKAILMPHGHAVALIKPQFEAGPAHVGKHGIVRDPQVHRDVLKMIVNFASATGYNVLGLAYSPIKGGEGNIEFLIHLQNADQTPGEIAPTVDIERTLSDAYAALKRP

SEQ ID NO: 163 - protein, 375 aa, Lactobacillus rhamnosus
TFAGFFASASAATTLADKVAPIFGSWSFAHEAAVILVTLILSYFSLVFGELYPKQVALQMTERVAKISVTPISWLATLMRPFVWLLSASTKLLMKLTPMEFSHEGESVTREEMVAMIENGRNAGAIEPDEYQMFEGIISLSDTMAREVMVPRTDAFMIDAKEPDQSAIDAILNNIYSRIPVYEEDKDHVIGIVHIKNLLKEARRVGFEQVKIESVMTEPVFVPETIPVDVLLTEMQTKQQQMAILLDEYGGVVGIVTIEDLLEEIVGDIDDESDQAEKLYTKQTDHDFIVSGRMPISEFNELFKTNLDAPDVDTIAGYVLTQLGAIPSTHHSERLELAPGVQLATGKVEGSRLVNVHIHLSETPPLEVVSKEADS

SEQ ID NO: 164 - protein, 150 aa, Lactobacillus rhamnosus
MRVSKSSHYEFNNEMFSAITHAFALGLAVTGTIALGIKGVNSGSQVELFSLIGFGVSLMLLYTASTAFHGFYFSKARHVLQVLDHSGVFILIAGSYLPYCLVAIGGKLGIGLLIAIWALCLGGIAYKLFFLNRFKHLETMIYVVLGWLCL

SEQ ID NO: 165 - protein, 771 aa, Lactobacillus rhamnosus; identical to SEQ ID NO: 137

SEQ ID NO: 166 - protein, 384 aa, Lactobacillus rhamnosus
NKNGDKPDYVTNKAKTAKILSRYLAIGEDKVLARLNPSKNLFQVEFGRPGTKLSLAIKKQIEAEKLPGIHFRETPSRLYPNGVFASHVIGLAQAQDNGGGLTGVMGLEKQFNTVLTGTNGYRRSETDAYGYKLPNAKTKAKAPVNGGSVYTTLDSGLQAYLETLMTDVQTKYEPKGMTAVLMNAKTGRILAATQRPTFDASTGEGLGDMWRDSLVEDNYEPGSVMKIMTLAAAIQSGKYHPNEYFQSGSVKLDGGTVNDWRTGGWGSIPLSKAFPLSSNVGMVKIEQEMGAGIWKSYLDKFKFGQKTGITLPGETSGRISFQRPLDQAITAFGQGIEVNVMQMMQAISAVANDGKMLKPQIVSKVVNKNGKATVYKPEVVGQPI

SEQ ID NO: 167 - protein, 588 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSD

SEQ ID NO: 168 - protein, 149 aa, Lactobacillus rhamnosus
GMGSQTGGSTLTQQVVKMMFLNSETTFKRKAAEIMLARRLNNHFSKNTILATYLNVATLGRNNKGQNIAGVEAAAQGLFGVSAKEVNLPEAAFIAGLPQSPFVYTPYTADGKLKTSLKAGINRQQTVLFRMYRAGVISHRQYVAAKSFD

SEQ ID NO: 169 - protein, 134 aa, Lactobacillus rhamnosus
SCKAEAAQKAVTAVASSTASASSTSASSSTTASSNSLGSSKAASSQAPASAGSSTVSVSGGSIAGNAAKYLGVPYVYGGTSPAGFDCSGLIYYAAKEAGISLPRTSQAQSTLGSYVSVSDLSFLMRRFSEVIRR

SEQ ID NO: 170 - protein, 503 aa, Lactobacillus rhamnosus
MPWIIAAVLLILLFIFLATHRKTALPNEVLIISGALISGKHSFRDVNGNRVKLITNGGSFILPILQRWDVLSLNTRTIEVATPEVYTQQGVPIIVNGTVILKIGSSQEEVATAAEQFLGKNDEQINSEATEILEGHLRAILGTLTVEDTYQNRDAFAEKVQDVASSDLAKMGLQIISFTIKDIADKNGYLDSLGKKQIAEVKKNAAVAEAAANRDTRIQQAQADQEAKQQEIERQTQIADAEREQQVKMADFKKQQEIAQAQADQAAIVEQMKAKQVQKEKDIELAQKNAELQEQELNATVRKQADADLYKAQRAAEAQKATQIAAAEASAKEVELDAEAKANATKAIGEAEAGKTKAIGLAQAEAIAKQAEAARQLDESGRFKMTIEAMPKIIEAAMSPYANVDSIKLYGDGDLTNQTSGSLVKQLDMLQEVAGIDIRGMLNGALMHQAGNQPVVDAIKHHEQPAAKAPDTKQPAPAPKSDQPATTEQAASSTPSRMAEKQK

SEQ ID NO: 171 - protein, 240 aa, Lactobacillus rhamnosus
MTKKASGTSRLLRWFVILLFTAGAACFCYPFAATAINELLLTSRRAAAQQEAKQNAAAQDEQRAAENRALAQTGLRPGQDPFQSRQKFNQAYVKRHLIGRVVIPKLAVDLPLFDTTNNTLLDQGAVVLPGTSYPRGGKSTHTVISAHGGLPTKRFFTDLSKLKRGQKFFLQVNGKKMAYQVFRIKTVRPDETQSLRIEPGRDLATLMTCTPYMINSHRLLVTGKRVPYTEALEHAAESAD

SEQ ID NO: 172 - protein, 270 aa, Lactobacillus rhamnosus
MLKKKLWFLLPLVALVTFTLTACTSASSDTSKNSDVTAELINKNELTIGLEGTYAPFSYRKDGKLEGFEVELGKALAKKIGVKAKFVPTQWDSLIAGLGSQKFDLVLNDISETPARKKVYNFTTPYMYSRYALITRSDNTTIKSLADIKGKTFVEGTGTPNAALAKKYGAKITPSGDFTVSLSLVKEKRADGTINASAAWYAFAKNNSTAGLKSQTLKDSVVKPDEVAGMVSKKSPKLQAALSKGIQELRKDGTLKKLSQKYFGTDLTTK

SEQ ID NO: 173 - protein, 108 aa, Lactobacillus rhamnosus
MRLQEKVAKRIHELRLSKSMTQEQLAEKANMDVSMLARIERGSRGDIRMSTLERIVSGLDVSYQEFFTFPEDGDETTELASSIALIKDPEVIRALHKIVNTLIHRDNK

SEQ ID NO: 174 - protein, 414 aa, Lactobacillus rhamnosus
ILLALLFGVGAATTSVMANTQYMTVKAESVNVRLGPGLAYGIMGQVKSGNELTIIGSKNSWYQVRLAGNKIGWVASWLVDQSEAATTSAKVATVNQPVNVREYASQDAKQLGTLNAGDSVKVVYQEGDWTQIAYNNTAAWITSSSVQLTGQTTNLAQPAQANLTQAKSGAALKVTTNTITNLRNAAGINAPSVEKLDKGTELTVTKQQDDWYQVTAPDGKSGYVASWTVTAPNNGQTQKAATKLSEATIVLDPGHGGTDTGAPANNNHDYEKTYTLKTAELVANALRAAGANVIMTRTTDTFVDLAPRPTTANNAHADAFISFHFDSSPSKNSASGFTTYYYSSKKDLALAKAVNNAFDDLPLENRGVAFGNYEVLRDNKQPAILNEMGYINNDKDFKYIKNPTYQSKIADGYC

SEQ ID NO: 175 - protein, 488 aa, Lactobacillus rhamnosus
QLRKDLKHKMKTVPIKYYDTHSNGDIMSRAINDMDNIASTLQQSLTQMVTSAVMFVGTIWMMLTISWKLTLIALVTIPLGLIVVGIVAPKSQRFFAAQQKALGLLNNQVEETYGGQVIIKSFNREDDEVEAFEGQNQAFYDAAWKAQFVSGIIMPLMIFLNNIGYVFVAIMGGIEVSNGTITLGNVQAFLQYMQQFSQPISQLANLANTIQSTIASAERIFAVLDEEDMQDEPSGVPAVANDPNKLVMDHVQFGYTPDALLLKDYNLQVKPGEMVAIVGPTGAGKTTIINLLERFYDISGGSIRLNGTDTRDMKREDVRAHFAMVLQDTWLFTGTIWDNLKYGREDATDDEVLAAAKAAHVDNFVRQLPDGYNTILNEEASNISQGQRQLLTIARAFVADPEILILDEATSSVDTRTEIHIQHAMNRLLTDRTSFVVAHRLSTIRDADKIIVMNHGSIVETGNHDELMAKNGFYADLYNSQFSGNVAI

SEQ ID NO: 176 - protein, 445 aa, Lactobacillus rhamnosus
KLNGAAGSVLNINGGNLTLTDDGVSAGTLTGGGFLNISGGVLDITGGNHTFAVSTIIAKDATVRMNDVSGLGTGNISNAGTLSLTHASGLLSNNLSGSGTVSLINSDTQISGNNSNYSGLFVVDTSSQLTATGAQNLGIASVSNRGILQLNNTTDWQLINNVTGTGNVRKTGSGSLTVRSNAAWSGQTDIDDGSLILGQSDAPVMLASSLVNIAKNGKLTGFGGVVGNVTNSGSLDLRSAAPGNILTIGGNYTGNNGTLLINTVLDDSSSATDKLVIKGDASGKTRVAVTNVGGSGANTLNSIEVIHVDGNAANAEFIQAGRIAAGAYDYTLGRGPGSNYGNWYLSSSKNTPEPRPDPEPTPEGHDNNLRPEASSYTANIAAANTMFVTRLHERLGQTQYVDAITGEPKATSMWMRHEGGHNRWRDGSGQLKTQSNRYVIQLGGD

SEQ ID NO: 177 - protein, 393 aa, Lactobacillus rhamnosus
MLEKKFYHTMFSHSFNIPVRVEYWDHTEETYGTGEPTITIKMKKAIPVRLLLKNASLALGEAYMRGDIEVLGGKRPLQQLIAAAYANADSFMRNNKLMRVLPKQSHTERKSKQDIHSHYDLGNDFYKLWLDPTLTYSCAYFENWDDDLETAQLNKIDHILRKLNPQPGRTLLDIGCGWGTLMLRAAKTYHLHVVGITLSKEQFKLVSDRIEAEHLNDVAEILYMDYRELDREPFDYITSVGMFEHVGKENLEEYFKDVAKLLKDDGVALIHGITRQQGGAVNAWINKYIFPDGYVPGMTENLAHIVDAGMQLDDLEPLRRHYQRTLEIWDTNFNNHRNPIQQKFGYEFTRMWDVYLQAAAASFEAGNIDVMQYLISKGPSGKDLPATRDYMYE

SEQ ID NO: 178 - protein, 103 aa, Lactobacillus rhamnosus
KYSYFRANEDYAEIARYLGLPGKTTDELVESYVQAFIKLAHSVGIKLSLKDQGVQKADLDKQVDRLAELAYEDNCTVTNPQEPLISDLKHIILDEYEGTDSTF

SEQ ID NO: 179 - protein, 456 aa, Lactobacillus rhamnosus
ISWHRLRPPDRMYVEKYIASAKHVEVQVLGDEHGHLLHLFERDCSVQRRQQKVVEIAPAVALPLALRNRICQSAVDLMASLHYENAGTVEFLVDGDQYYFIEVNPRVQVEHTITELITGVDIVQSQLRIAAGADLFADLHLPQQDALRENGAAIQCRITTEDPENNFMPDTGTINTYRSPGGFGIRLDVGNAYAGAVVSPYFDSLLVKASVHAPSFPAAVAKMQRALHEFQITGVKTNVAFLEHLLATQTFRTGEAETAFIDAHPELLQVQAKPDIASRLLWYISDVTVNGFKGVERQSQKYYPELQYTRHFAAAKPQTDLVALLKNEGAQAVTDWVKAHPALLLTDTTFRDAHQSLFATRMRTRDMLTVAEDMGNGLPNLFSMEVWGGATFDVAYRFLNEDPWVRLKKLRAALPHTLLQMLFRGSNAVGYQNYPDNVIKAFINQAANDGVDVFRI

SEQ ID NO: 180 - protein, 383 aa, Lactobacillus rhamnosus
MKEAELIAIRRQLHQIPELALQEKETHAFLLKTIQSFPQTFLTIRTLPKLPTAILVKVTGSDPQRTIGYRADMDALPVTEATGLPFASHHPGIAHACGHDMHMTVALGVLSYFSIHQPKDHLIFFFQPAEESKNGGKLACDMGAFTGEWQIDEFYGLHDRPDLPAGTISTRLGTLFAGTTEINVDLIGKSGHAALPQNANDMIVAAASFISQIQTVVARNVGPTDSAVITFGLMRAGTIRNVIAGSAHLEGTLRGFTQKQINFLQQRIRDIGQGIAASFNCEVKVDLNQGGYYPVENNPHLTKDFIDFMQADPAVTFVPTDPVMTGEDFGYLLNKIPGTMFWLGVNDPDSQLHAADFSPDEAALAPGVTAIIHFLTHRMAEAA

SEQ ID NO: 181 - protein, 267 aa, Lactobacillus rhamnosus
ATTVASAENTDVITQAVTITDASGLKLGPETVQLSSNDFVDSFDQKKFYVVKDASGKLSTGDAGDYTADAKGKIAIVKRGSLTFTDKQKYAEAAGAAGLIIVNNDGTSTPLTSISLTATFPTFGLSNTTGQKLVDWVTAHPNDSLGVKIALALLPNQNYKADRMSSFTSYGPVSDLSFKPDITAPGGNIWSTQNNNGYTNMSGTSMASPFIAGSQALLKQALNNKDNEFYADYKQLKGTALTDFLKTVEMNTAKPINDINYDNVIVS

SEQ ID NO: 182 - protein, 248 aa, Lactobacillus rhamnosus
MHPLFGYLTAWSNIFQFVVVGMSEMIAIGEYFKFWWPELPAWLPGLVAITFLVLANLISVRMFGELEFWFALIKVVTIVLMIIAGLGVILFGLGNGGRPVGISNLWTHGGFFTGGFTGFCFALSIVLGSYQGVELLGITAGEAENPQPTIVKAVKDTIGRILIFYVGAIFVIVAVYPWNQLSALGSPFVQTFAKIGITFAASLINFVVITAALSGSNSGIYSASRMLYTLADAKQLPRIFTKLNRHGV

SEQ ID NO: 183 - protein, 114 aa, Lactobacillus rhamnosus
IIIGTTIVIPGIVMHFFCGGIAAIFGNATGGRKGALIGPFIGGIILSFLPLVATGLYGGLGYTATYWSDSDFNTIGVLLGLVAKVGKWPIMLAALIIFAFPFVFSALHKKKLVD

SEQ ID NO: 184 - protein, 440 aa, Lactobacillus rhamnosus
MLRTLKNALKVKDIRNKILFTLAVLLVYRLGTLIAVPGVNAKALQSIGSTGLISLLDTVSGGGLAQYSIFSMGVSPYITAQIVVQLLQMDIVPKFVEWSKQGEVGRRKLNQVTRYLTIAFGFFQAIGITAGFQTLSSMGLVKNPSVSTYITIGIILTGGTMLLTWMGEQITDKGLGNGVSLLIFSGIVARLPSGLQELYRDNVQVYSGSEIWKGIAFLAALAVIVILVITFVTWVQQANYKIPIQYTRRVTSAGSNSYLPLKVNVAGVIPVIFASSFIVTPQTILMAFQKNHGTDGWYQVMTNVFNMQKPAGTAIYTLLIILFTFFYAFVQVNPEKVAENLTKQGSYIPGVWPGKETENYISRLLMRLSTVGALFLGLVALLPQLAANIWGLPQSIGLGGTSLLIVVMTAIELVRQLDGLLMKREYVGFIRGDLVKNDKK

SEQ ID NO: 185 - protein, 173 aa, Lactobacillus rhamnosus
MPRGILGSLLIAVFLFVSVGLVLLGMFPYQDYANNAEPVGWALRHSGHAVVATVVESIAVLGMFTALIGMAMAGSRLLYSFGRDGMLPHGLGKLNSRKLPNRALAVLITIGVIIGAFFPFAFLAQLISAGTLIAFMFVTLGIYRLRPREGQDIAKPRFRMPFYPVLPAVAFLG

SEQ ID NO: 186 - protein, 220 aa, Lactobacillus rhamnosus
IAQSPQAKKAGLKLKVKQVADGNVTNSATAEGQLDVNAFQSYAYFEQYNKANPSQKLAALGTTYLEPMGLYSKKYKRLSQLPDGATIGISNDPANATRGLLLLAAAKLITLKPDFNALSTVKDIQSNPKHLKFKEVDPSVQVLPDLDAGLISNTRALDGGLNVLKDSLVHEKLSQDTRANVNILVTAVKNKNKLELKKLVTLYHNSTIQAWIKKTFSGTK

SEQ ID NO: 187 - protein, 98 aa, Lactobacillus rhamnosus
IAGIFILGTNGESYVLAEDEKLAFVEHVIDYVHGRTKVLVGTGLNGTAETIRFSQKVASLKPDAITLVAPSFVAPSQQELVDHGWEESNQYVGCDGSQ

SEQ ID NO: 188 - protein, 240 aa, Lactobacillus rhamnosus
LSQYMVTDNDKMEADLDDPYILITDKKISNIQDILPLLQEIVQQGKALLIIADDVAGEALPTLVLNKIRGTFNVVAVKAPGFGDRRKAQLEDIATLTGGTVISSDLGLDLKDTKIEQLGRAGKVTVTKDDTTIVDGAGSKDAIAERVNIIKKQIADTTSDFDREKLQERLAKLAGGVAVVKVGAATETELKERKYRIEDALNATRAAVEEGYVAGGGTALVDVLPAVAALKEDGDVQTGI

SEQ ID NO: 189 - protein, 497 aa, Lactobacillus rhamnosus
LDPSKASEGVSGQAIIDTMNGLYKYYGHKLQPAMATKIVKPTNNGLTYTFTLRDAKWSDGTPVTAQDFVFAWQRTVNPATKSSQANMYSGIKNADDIRAGKKPAATLGVKAINSKTLEVTLEHPIPYFNSLLNNVAFFPQPAKKVQEWGNKYGTKSEYTLSNGAFKSKGWTGTGDKWTEVKNNRYWNQKNVHLTQIDVQVVKDTNTALDLYHTGKLDDATLTGPTCRTTKVRPVMSPPNAPARIFLELNENKVPAFKNTKIRQAISMAINRDSFVKNVLADGSIVARGITPADLSQLPDSSTDFATAVGKGTKTITTYNKKKAQTLWNQGLKELGIKNVNVELLGDDVDAVKATQEYLQGTLQENLPGLKISIASVPAKNRQQRASTRDFDMVLSTWGADYPDPNTYLDLFTSTSEYNHGQWQNSDYDQLMAKANGADANNPTARFKDMTQAEQLLVNQAGAIPLYQLVAARMVNPKMHDLKTSPGNSFNFVYAYLK

SEQ ID NO: 190 - protein, 121 aa, Lactobacillus rhamnosus
VKNISDYRNKKVLVLGLAKSGVNAARLLHKLGALVTVNDKKQFDDNKEAQELLADGMRVITGRHPVELLDEHFELMVKNPGIPYSNPMVQRAQELGLPIITEPELAFQVSEAEWIGITGTN

SEQ ID NO: 191 - protein, 267 aa, Lactobacillus rhamnosus
IVFLAYLGYSIWNIWRYIHNQRLKWPHFGLSLDTSRLPFHLPQAVTVFGIAFFALMTAVSEMNRPQLLTRTFDRNYIVKYLGLAPFTIYDAAKTAQNNQVRAQADSANLDPVLQYTRSHYAAPNASYYGAAKGKNVIIIHLESFQQFLIGQKIDGQEVTPFLNSLIKEKDTLSFNNFFHQVGLGKTSDAENMLETSTFGIANGSLFSSLGTENTFEGAPAILNQRAGYTSAVFHGGSASFWNRDNVYKSLGYNNYFSGNFYNHDEKA

SEQ ID NO: 192 - protein, 227 aa, Lactobacillus rhamnosus
VVKGVNLNVANNEVVVMIGASGAGKSSVLRMINGLETVTSGEILIDGEDIAHKGTNINKVREKIGMVFQHFNLFPNMSVMGNITLAPIELGIASKEEATQQAKEMLEVVGLTDKADAMPAQLSGGQQQRVAIARALAMHPDIMLFDEPTSALDPEMVGDVLGVMRRLAKQGMTMVIVTHEMGFAKEVADRVVFFDNGTILEQGTPTDIFEHPKEERTKSFLNKVLNA

SEQ ID NO: 193 - protein, 141 aa, Lactobacillus rhamnosus
ITLSNQLTPSRNAQKYFAKYTKLRNAVAHVHQQMQENQEELDYLEGIMAQIDVASPKDLVDIRLELQQQGYLRKQKSGKKGNKRQKVSKPDQFYASDGTKIWVGKNNLHNDQLTLHTAKKTDIWLHVKDIPGSHVIIDSSD

SEQ ID NO: 194 - protein, 305 aa, Lactobacillus rhamnosus
MLTIGVIGLGTIAQKAYLPVYAQMQNQVHWLLNTRNEDKLEQLSAQYGLESAGHSLQDLDGQPLDAVMIHTPTATHYQYVKHFLEKGVHVFVDKPLATDMAQVNELYDLADAKHVMLTVGFNRRFAPMIQDLAQVTDKTGVRVDKNRIDALDDTEHALWDLFIHPVDTALMLAGYPEKPNTRYALHTTSDGQLQQASVTFTAPGIRGEAGIDLQAGTNLEEAQVAAPSGVQRVQNLDQLVVYGRGGASQTFAPDWQPMLETRGFAPMVQAFVQAVGNPDGQNPVSPATSQLAHAVVADLVNQINN

SEQ ID NO: 195 - protein, 234 aa, Lactobacillus rhamnosus
MHIAVIDDQAATREATVKLIRQLAQPSQPLQVAAYSNAEQFLFAEKSADLLLLDIKLGSGMDGMALAKKIRQHDPETAIAFVSNYDEFVFDGYDVNAIDYILKPLTVAKLKHLIEKVASQTQPKLLALQTAAGLVRVPMYDISAIEVTDHRLQVHTQKNHYLVNGQLKDFLPRLDDNFIQIYRSIVINLNFLSQLDKRTVVMADGTTYPVSRQQAPLVKQAFFKHFRGLTHDSN

SEQ ID NO: 196 - protein, 216 aa, Lactobacillus rhamnosus
LNESIVDFIRDFSQPEAALTGADGLYLAEEGIFDAIVLDIMLPELNGFDLLKQLRAKQVKTPVLILTAKDALTDKVRGFELGGDDYLTKPFHREELIMRLKALLKRTGHFFDEDGLTAGPFEVHLNRHEVLIHDKPVALNGKEFDLLVYLLQNQKTIITKDQIFDRLWGFDSDTAVSVVEVYMSNLRKKLKPMQADVWIKTIRNVGYIFQEPEDRA

SEQ ID NO: 197 - protein, 207 aa, Lactobacillus rhamnosus
TAPATAYTKMDDFLGSDVDVVYIASPNSLHASQALAALDAGKHVIVEKPLVATAMEFEKLDEALRKKPSLYLFEAARHVYEHNFQVVDQFTHHHPIDGATLTYMKYSSKYDAFLAGKLPNVFNPEFAGGALMDLGIYLVYDAVAWFGVPDNAVYLPHFLKSGVDGDGVARLDYDQFAVTLITGKTTNSFLPSEIYSGKQTLTMDNAA

SEQ ID NO: 198 - protein, 464 aa, Lactobacillus rhamnosus
MGYQVFILLLPIVTIPYVSRVLGPTGIGINAFTNSIVQYFVLFGTLGLTMYGNREVAYQRDNPKRLSGLFWELTLLRLVTTGIATLLYLGFILLSGEYQVFYLIQGLLLVATAIDVSWLFQGLEEFRITVLRNTLVKIISLILIFVLVRTKNDLWLYILILTGSQVLGNLTLVPYLKKYVVVPHWYDLKVIDHLRPTIEMFVPQIATQVYLQVNKTMLGALVGVQASGFYDNSDKIVKILLAVVTATGTVLLPHTAHSFAQGKHDEVEASLNKSMHFILVIAFPMTTGLAGIAPIFTKIFFGKGFDPVANLLVIESIVIVLIGISNATGVQYLLPTNQLRPFTTSVVFGAVANMVLNVPFILIWGSNGAMIATVLSELLVSIYQLSKVRNQLRIRSLFSEVWKYLVAALLMGVSVRVFINVLPLSNFLALLGATMYGALIYTLALVILRPKILLQMISSLRGLR

SEQ ID NO: 199 - protein, 179 aa, Lactobacillus rhamnosus
DRMTAFIQTMSHLSALQNRQLTGEAMTPATLEQQLKEEASKLVPATKTVTWKVENQMTTNESLAIAPDVVLEVFDNQLTNACRFAAEQVAIHLTATANGLTIKVDNDGPPLTPGEQAKAKLPYFSSDRQAQHLGVGMYICTQLCAAHRGHFTIANQPDTQGVSTIAEFGFLTPASSSTD

SEQ ID NO: 200 - protein, 148 aa, Lactobacillus rhamnosus
MSLPIFLELVEIRTKLASVLPFAIGTLFAVTYFHAFDWLNTLLFFTAMLIFDMMTTALNNLMDYQKAKDAHYQQEVNVIGRAQLDPGMVAKLILVMLVVASLLGVVLVVRTDWLLLLMGMACFAIGILYTWGPLPLSRLPLGEIFSGI

SEQ ID NO: 201 - protein, 269 aa, Lactobacillus rhamnosus
LKIAKLNNHPYLITSASTAQPITNAADVLTALTHRDTLTFGSEINFKPEQLEAPVAASSQIFAIGMNFLDHSQEIHIKLPEVPSVFTKFSSSLTGPTSTVPIHGPKTDWETELVVLIGKGGRNIAEADALKHVAGFLVGEDFSDRAVQFANAEPQFSLAKSFQNYSPIGPWVTSTDAITNLDQLQITTTVNGHIMQQAKLDQLIFKVPALIHYLAGIVALQPGDLIFTGTPSGTGVGRDPQIFLQPGDHVTAAISQLGALNLTMPTPQN

SEQ ID NO: 202 - protein, 193 aa, Lactobacillus rhamnosus
VIELKRIIVGITGASGTIYAVNLLQHLHRLPDVEVHLVMSAWAKQNLSLETDMKQSELEALADYVYPVQNQGATIASGSFLTDAMVIVPASMKTIAGIAMGFDDNLIGRAADVTIKEQRQLIIVPRETPLSPIHLDNLAKLAHIGVQIIPPIPAFYQHPQTIQDLIEHHTMKLLDALHIKTETASRWNGASLR

SEQ ID NO: 203 - protein, 405 aa, Lactobacillus rhamnosus
MRKQLPKDFVIGGATAAYQVEGATKEDGKGRVLWDDFLEKQGRFSPDPAADFYHRYDEDLALAEAYGHQVIRLSIAWSRIFSDGAGAVESRGVAFYHRLFAACAKHHLIPFVTLHHFDTPERLHEIGDWLSQEMLEDFVEYARFCFEEFPEIKHWITINEPTSMAVQQYTSGTFPPAETGHFDKTFQAEHNQIVAHARIVNLYKSMGLDGEIGIVHALQTPYPYSDSSEDQHAADLQDALENRLYLDGTLAGDYAPKTLALIKEILAANQQPMFKYTDEEMAAIKKAAHQLDFVGVNNYFSKWLRAYHGKSETIHNGDGSKGSSVARLHGIGEEKKPAGIETTDWDWSIYPRGMYDMLMRIHQDYPLVPAIYVTENGIGLKESLPAEVTPNTVIADPKRIDYLKK

SEQ ID NO: 204 - protein, 222 aa, Lactobacillus rhamnosus
MKNRLDDITDLMALGPTPDARDIQRRQTAHRIAIADAWQIQPGENILEIGCGQGDLSAVLADQVGPSGHVTGIDIASRDYGAPLTLGQAWDHLLNGPLASRLTVHFDTNLAASLGPVANQHFDRIVMAHSLWYFASANAFALLLKNLRTIGDYVDLAEWSLHPTALNQIGHLQAAMIQGLLYAIAPSDVANIRTLITPDTLAQIAHDNTWSYTAGKLIECPD

SEQ ID NO: 205 - protein, 51 aa, Lactobacillus rhamnosus
TYTGATIGHLSAAQKKAAYRFGRQLGMAFQMIDDLLDYTQTAKTLNKPALE

SEQ ID NO: 206 - protein, 280 aa, Lactobacillus rhamnosus
TLTDWQTAINHTLDEQLATVVNPHLRAAMAYSVDAGGKRLRPLLLLSVVAMYDGVVAEALPAAAALEFVHTYSLIHDDLPAMDNDDLRRGQPTNHKQFGEALAILAGDALLTDAFAILSQHYPGKGAELVQILAEAAGSSGMVAGQVLDMDGEQTQYDLATLKQMHQAKTGALIQAGVAMGSLFVAIPEADQAALADFAAAFGLGFQIKDDINDVTKTTAELGKTADKDVAEHKNTFPELLGLAGAKQALATQFQLATAALNSLTVDATDLKSILAVLQA

SEQ ID NO: 207 - protein, 20 aa, Lactobacillus rhamnosus
EQIQQRLEQVVTLREPQVHT

SEQ ID NO: 208 - protein, 99 aa, Lactobacillus rhamnosus
RNLAYKAALALQRHANIRQGARIHIEKHIPVAAGLGGGSSDAAAVLRGLNSLLQLGYSRSQLARIGLQVDSDVPYCVYSETALVTGRGDVVTPLGSLPN

SEQ ID NO: 209 - protein, 39 aa, Lactobacillus rhamnosus
EKWYLVAHPGVSIPTPVIFKDPELPRNTPKRSIETLLKC

SEQ ID NO: 210 - protein, 72 aa, Lactobacillus rhamnosus
MELIEKAPAKINLSLDALYRHADGEHEWQMVMTSVDLADYVSIKPSHSIQVSTDSGFLPEDPRNLAYKAALA

SEQ ID NO: 211 - protein, 108 aa, Lactobacillus rhamnosus
IGLTTARPVLYDRINARVDTMMAAGLENEVANLLKTVPPDAQALQAIGYKELIPYFRGQADLATCVALIKQHSRHFAKRQLTYFRNQMPTHWFDLVAHPEEKTAVRCF

SEQ ID NO: 212 - protein, 73 aa, Lactobacillus rhamnosus
DQADLAALGVSSPELDRLINVALDNGAYGAKLTGSGMGGCMIALAAADQAPAIIQALKVANAVKVWEYHFETK

SEQ ID NO: 213 - protein, 163 aa, Lactobacillus rhamnosus
QMAYSVAKFKAAAEAAITDVSSRRHLPILVGGTGFYLNSLRLNLPLGGKAPPTAVRQRWQAALAENGEHWLWEQLQQQDPVAANQIESANTRRVIRALEVIELTGTRFSEQPQPQPRYETLVIGLTTARPVLYDRINARVDTMMAAGLENEVANLLKTVPPDA

SEQ ID NO: 214 - protein, 106 aa, Lactobacillus rhamnosus
TLWVPVLGNVNATWFYVIFVVFWLVGFSNAVNLTDGLDGLVAGQTTISFATYAVIAVREGRVDVLIICLVTVGAMLGFLMFNHKPAQIFMGDLGSLALGGMLAVAA

SEQ ID NO: 215 - protein, 104 aa, Lactobacillus rhamnosus
LIIISAIWVSIWQHQLTLSVWISLFILVLYGLLGFYDDFQKLVHHRNEGLKAWQKLAGQILGAVIFLIRKIAVSVSPISCFWILLKAAAKACCLVSPLPDTVTT

SEQ ID NO: 216 - protein, 154 aa, Lactobacillus rhamnosus
ARIPAHIAIIMDGNGRWAKRRLLPRVAGHKQGMQNVKTITKAASRLGVKVLTLYAFSTENWKRPGSEVNYLMRLPVDFFNDFMPDLIKENVKVEVMGELTDLPEPTRKASEKAMADTANNTGMILNFALNYGGRDELVHAARKLASAVRDGQLD

SEQ ID NO: 217 - protein, 39 aa, Lactobacillus rhamnosus
AYSELVFVDDYWPDFSPAALEAAIATYQARDRRFGGLKK

SEQ ID NO: 218 - protein, 224 aa, Lactobacillus rhamnosus
VNLETASEHRRTDVEQVNLGGLTPTYLVSKRCFDVAASFIGLVLLSGVFLVLAVLIKLDDPHGKVFYSQTRLGKDGRRFQMWKFRSMVAGADKMVDKLLKKNDVDGAMFKIKQDPRVTRIGRVIRKYSLDELPQLFNVLRGDMSLVGPRPPLPREVVKYTEYDRQRLAVVPGVTGLWQVSGRNELGFDEMVALDIHYINHASVAEDFRILFKTILVVIHPTGAY

SEQ ID NO: 219 - protein, 85 aa, Lactobacillus rhamnosus
MSATAEAKSGPVLAKAHDSRITPVGKYLRKFRLDELPQIFNVLKGDMSIVGPRPERPYFVNQFNQQEPHYYLRHNVRAGITGYAQ

SEQ ID NO: 220 - protein, 465 aa, Lactobacillus rhamnosus
MTINWQQEVEKLEPQLLSDLTTLLKINSERDTDHQTDEYPLGPGPAKALEAFLAIAQRDGFKTLNVDHVAGRIELGDGDEIFGLFGHVDVVPAGPGWQTDPFDPVIRDGKIYGRGTSDDKGPSIAAYYALKLIRDLKLPINKKIHFILGTDEESDWVGIHRYLETEPAPDFGFSPDAEFPIINGEKGIASFEIVQKPIAAATADLTLNHFSAGIRPNMVPQEAKAVLSGPLPEAFVTQAEKWAAEQEVTLTLTLGNPTTIELIGKGAHAQEPKDGKNAATYLATLLADLPFDPAGKAYLTMIANHLHLDSRGHHLGINYTDKLMGDLTASPFTFTQDGPQSVLVNVRYPQGTDAAKIRDQIETALGADQYNVAVSGHAQEPHYVSGDDPLVKTLLQTFSDHTGIPGHEQVIGGGTYGRIIKRGVAFGAQMPGQENVMHQANEYMPIKDIVAAVAIYADAISRLVM

SEQ ID NO: 221 - protein, 439 aa, Lactobacillus rhamnosus
MKNETLAALYEAQRMTFIQALRQIMQIKSVRGSQQADAPFGRGPRAALTAAAELGKAYGFKTGIVNSAMAYIQWGDDDQHYIGIVGHLDVVPAGETDWHFPPYDLSEKAGRLYGRGILDNKGPSIACLFAMKLLKDAGFQPKRTIRLILGSDEESGSADVPLYLAKEAPPEFGFTPDCKFPVVYGERGIVNFNLRTPITDDSLDKVATITGDQASDHVPDHLQATINDKRYTASGIRAPSNAPELGKNAITTLAKELLDEHAIHGQFANYCQWLVQTLANQHHGEGLGMDFADAASGRLIVTPYQLQKIGAVISLRVAVRYPVTYQEHDVTRALTAAVFPRTQITVIRSMPGILHDKNDPRLAALTQAYEQVTGREGQPVTTTGATYARKMPNIVAFGPSFPGQKGIAHKADEWMDEHDLKLNMMIDMNAMIRLGAMDK

SEQ ID NO: 222 - protein, 187 aa, Lactobacillus rhamnosus
MSAVPKRIQKWSWLLAITVLNDYWAKQPVPGAAFPGMGNSKTKATGEMNPTSGATKGNNSKTGTAPTGTKGNPPTGTKGTKGTTGTPPGGNGGGRPGNGQGQGGTPPAGTNGKQPTVKTKSGTSTNNAPANFAEGNFKGGRGTGGGAAGGRGGGAAGGRGGGAFSIGNAGPLRLLQSDLGNRWPWHG

SEQ ID NO: 223 - protein, 175 aa, Lactobacillus rhamnosus
SRIGYKVIKVPAGVTVTKDGDNITVKGPKGELTRHFAPEIELHQEGDEINFTRPDDSYKAIHGTMRANLNNMVVGVTEGYKKEMKLVGVGYRAQKQGEKLVLNVGNSHPVEMPAPKGVTVEVPSTTQIIISGISKQVVGQFAAVVRSVRAPEPYKGKGIRYVDEHVRRKEGKTGK

SEQ ID NO: 224 - protein, 653 aa, Lactobacillus rhamnosus
MSAMELKSQGREAESAAADTVRLTTAQALVRFLNQQYLDVDGEVTPFVEGIFAIFGHGNVLGLGEALQEDPGHLKVYQGHNEQGMASTAIAYSRQLYRHKIFAVTASAGPGSANFVTAAGNAYVNNIPILFLPADTFATRQPDPVLQQIEVDSSATTTTNDALKPVSRYWDRIERPEQLMSALLKAFEVLTNPETAGPVTIALPQDTEGEAYDYPRSFFNKRVHVIKRIQPSAAEVTEAVQLIKASRYPVLIVGGGAKFSEAGSAIEAFSDKLNIPIVETPTGKSTISATFANNMGGTGILGTAAANEVVAKADLIIGAGTRYTDFTTASKTAIHPEKTRVLNINLNRMQSYKFDGFPIVADVRDTLTQLTSELSGYQSDFTNLADLKAAWQQERQRLAHTNYDAPDYTPEVKGQFSAATLAEYAEKLQTHFTQTEAVIAVNDTIAPDSIIVAAAGSLPGDVQRIWDPVVPNTYHMEYGYSMMGYEVPAALGIKLAQPDKESYALVGDGSFIMLHSELVTALQYHKKINILVFDNSGFASINNLQMAQGSNSYRTEFRTADHDILTIDFAKIAEGYGAKTYHVNDRDSLVAALEDAKKQTVSTLIDIKVLPKTMTQGYGQSWWRVGVSEVSDNPNVQKAYQDIQTGIDQAFKY

SEQ ID NO: 225 - protein, 340 aa, Lactobacillus rhamnosus
IVARHEQNAAFMAAGIGRLTGKPGVVLTTSGPGASNLATGLVTATAEGDPVLALSGQVKRADLLRSSHQSMRNADLFAPITKYAAEVQDPDNVSEIIANAYQAAESGKQGASFVSIPQDVTDSPVNSEPIKPLVAPKLGPASPSDMTYLARAIKEASLPVLLLGMRASSSDVTAEIRELLSVTELPVVETFQGAGIISHRQIDNFFGRVGLFRNQPGDMLLQHSDLAGYSGFAPEPKMHASTALNHLKEPPQLAAEQSSVVTMTRPPFLTITSVPAFVHEPESKIAPVPGCAESGAKVAADSCSLMAIAARFRPASAHPRGERLLNNGAKTVAYYRTVAG

SEQ ID NO: 226 - protein, 270 aa, Lactobacillus rhamnosus
MKRRMIMAVMAFLTMAGIVISGCARETVDNSWPRIERTKKVVIGLDDTFVPMGFRQKNGQLAGYDIDLAKAVFKRYGIKADFQTIDWSMKETELKNQTIDLIWNGYSVTPERKAKVAFSNDYLINHQILVTKTKSQINTLKDMKGKTLGVQTGSSGAFDLDAQPKLLKNMIANKTPILYDTFNDAFIDLDAGRIQGILMDEVYARYYIAHKPDPASYHIIGDSFPPEEFAVGMRKSDHVLREKINAGLKALKADGTIAKLQKKWFGKVEQ

SEQ ID NO: 227 - protein, 261 aa, Lactobacillus rhamnosus
  VARIANT (1)...(261): Xaa = Any Amino Acid
MKFWKRAIIXPLHWFYLSSSWRRAGKSSSSSSKNETVKVGIMSTDKEIWTDIQSRLKKQGVTIKLVQFTDYNQPNQTLXEDGDIQLNAFQHHNFLNNWNKKHNTKIADIGDTYIGPMRAYSNKIKSLKEVKQGDQISLPNDPSNEGRALQLLAQNKLITLKKGVASPTIRDITSNKINLKFTELDAAQTARSLNDVAVAVVNNDIAAAANLKPSNAIAVEKITSQSKPWVNFIAAKSSKDKNNATYKKIVKAYQTKRTANC

SEQ ID NO: 228 - protein, 71 aa, Lactobacillus rhamnosus
MMQGRVKNFNVDKGYGFIEAEGQPDIFVHFSAINESGFKSLTPGEQVDFVIVEGPRGPQAANVTIPSRTRH

SEQ ID NO: 229 - protein, 412 aa, Lactobacillus rhamnosus
  VARIANT (1)...(412): Xaa = Any Amino Acid
MNGGMTLQRVVVTGMGTVNPLGHSVAETVATMDAGKVGIQPITKFDAEKTGITVAGEVKDFKPEERMSKRLSKRMDLFTQYGLYSAIEAYEQSGLTEDAVDSDRVGVIFGSGIGGLTTIQEQVTKMYVKGPDRVSPLFVPEAISNMVAGQFPXYFGTHGPSYVVVTACASATNAIGEAAMRIQTGKADVVITGGAEASVNEIGIAGFAALSALSKNTDPTKASLPFAADRNGFVLGEGGGALILESLEHAQKRGAKILGEVVGYGATSDAYHMTAPDPSGSQAARAMQLAVEEAGIKPSEVGYINAHGTATKANDAMESKAIHDLFGDDVLVSSTKALTGHLLGAAGAIEAIMTLSALQSGRLPMNVVDAAQDEDCPVTLVNRDNRDTSVDYALSNSFGFGGHNAVLAFKRW

SEQ ID NO: 230 - protein, 308 aa, Lactobacillus rhamnosus
MMDPIREAMLKKSRSSKLERRGKTISLICISLIVLVVVAIFFFVASKGLATFFQNKINLWSFLSKSVWNPSIKDAHGNPEVGALPMIVGSFGVTFLSAIVATPFAVGAGIFMTEISHKWGQKVLQPVIELLVGIPSVVYGFIGLSVIVPFIRHIFGGTGFGILAGTFVLFVMILPTVTSMTVDALKAVPRHYREASLALGATRWQTTYRVVLRAAIPGILTGIVFGMARAFGEALAVQMVIGNAALLPKNLVSPASTLTSVLTSGIGNTVMGSLENNALWSLALLLLLMSLAFNLLIRWIGKKGELNK

SEQ ID NO: 231 - protein, 555 aa, Lactobacillus rhamnosus
MNKRILRRVLVISLLSLAGFFVLVTTVNQQIVHQQARDLRRVARTYAASAKDGVDPQALAKSEAAFITVVPDNPKTTRQKVMADALRGNHREPFVTTVNVLGRAEQAYLFRHRGHWVAVSRYKSSVWTTAPEQFWILTLTFAVLIALILAWLFRSEHQYQEAIRVMSHNLDRIRQKKEPEPVILPPQSPFTLVARRINALAAEQTHLREKVAVRQSSFDRLIDNLPLGVMLIDTNKDVILHNHAMSQLLGHQIPQPRHNYLDDVKTYALARMIEHTFRHEKTHHQELTVLATQKSVDASVIPLNQGTSRLQVLVILYDVTYLRQVEKMQLDFVGNVSHELKTPVTAISGFAETLLSGAKNDPATLDKFLKIIFDESKRLTQLINDILTLSRPESNQTVQAQVPLKKLVDDALRNLAKVIKDKQIRVEVAIAPDLQVVTDERKLTQIVRNLLNNAVFYNRLAGHVTITAQVVEGHLSLAVADTGIGIPETEQARIFERFYRVDKARSRHNGGTGLGLAIVSELVKSMDGQVAVSSQVGVGSTFTVTLPISKRQQQD

SEQ ID NO: 232 - protein, 662 aa, Lactobacillus rhamnosus
MKKSTRTILISVVAAIVVIVGGFGAFHWYQGKAEGDQVKATAQAYTKAFANRQYEKAVKQVDTSHLKGPGWQYTAKTLAERNQAVFDRIGASNIKITDLKTTNSKDGTYQLTFTANMNTKIGKLPAQHYTAPIVKVGDNWRIRWTPSLLFPQMDGKDTVQISLTAATRGKILDRNGQALATNGNVTQAGLVPGKLGTGDERTANLEKIATAWDVKTSSLETLLKQSWVTDDTFVPVKIVTDSPALTGAAYQTIGSRTYPLGEAAAQLVGYVGTATADDLKKHPSLTANSKIGKAGLEQIYDHYLRGTDGGTIAIRNGSNSHPLLDTKPIAGKNLKLTIDATKQKTAYTQLAGKSGSVVTMDPTNGELLTLASSPSYDPNAFVNGISQTNYDKYANNTELPFLSRFTQRYAPGSTFKMLTAAIALQNKTITPDTTKSISGLKWQKDSSWGDYKVTRTVDASPENMTQALVNSDNIWFAQVALKMGASAYLKGLEPLFKTQANLPLTMKKAQISNNGKLASETLLADTAYGQGQLLLSPIEQAAMYSAIANDGTMQQPTLIQAAKGKRTSVLQSNAAKTVKTALTHVVSDQAGTAHDLAIDGHTIAAKTGTAELKQKQDTDGKENGFLVAMDADKNTYLTVALIEGTGSGDVVTAMKPFVASLY

SEQ ID NO: 233 - protein, 297 aa, Lactobacillus rhamnosus
MSSLAEFFTALGKYDFLQSALITAIMVGIMSGLIGSFIILRGMSLMGDAISHAVLPGVAVAYMLGVNVMIGASVFGIIAALLIGFVAANSKIKTDTSIGVVFSAFYALGFILISMAESATNLHHILFGNILAVSDSDIMTTAVVLGIVILFVVLFYKELLITSFDNTFAKTYGLNTTAIHYALMLVLTLVTVSALQTVGIILVVAMLITPAATAFLWTDRLETMLVMAASVGVISSITGLYFSFTFNWASGPAIVLVAAVLFAISFVFSPKQAFFSFSKRQRTKTAATTQTAEEVIR

SEQ ID NO: 234 - protein, 288 aa, Lactobacillus rhamnosus
MSRLIKDSQAKIADFATQLTKANQEVSKRKSNLKDQLISLQKRAGDSVTGNVYFDFILNSDSLTDLVGRSLTVSKLSQASAEALQAVKDSEAKVKNLKAAQEANQKNLVATKSQLESDKAKIDGLKADADKAAADAQQTIDANKEKLAAMAADEAAKAEAAQKAVTAVASSTASASSTSASSSTTASSNSLGSSKAASSQAPASAGSSTVSVSGGSIAGNAAKYLGVPYVYGGTSPAGFDCSGLIYYAAKEAGISLPRTSQAQSTLGSYVSVSDLSFLMRRFSEVIRR

SEQ ID NO: 235 - protein, 459 aa, Lactobacillus rhamnosus
VKNISDYRNKKVLVLGLAKSGVNAARLLHKLGALVTVNDKKQFDDNKEAQELLADGMRVITGRHPVELLDEHFELMVKNPGIPYSNPMVQRAQELGLPIITEPELAFQVSEAEWIGITGTNGKTTTTTLIGLMLNQQWPHHAFDAGNIGIPVSQVAQKAGKDDTIVAELSSFQLCGIKTLHPHIAVLTNIYEAHLDWHGNRANYVAAKMRITMNQTPDDYFIMNWDLPEMHQLAKQSQAQIVPFSRKQAAGARASLIDGWLTFDGDKIMPASDMQIPGLHNIENALAAIAAAKLKGVSDDAIREVLRTFSGVKHRIQYLETINGRRVYNDSKATNVEAATVALNAFQQPIVWLAGGLDRGLPMDALTPLVKKHVKSMVVFGQTAPLMAKIAKDAGIPVQKTENVMTAVPLAYEASRPGDVILLSPAAASWDQYPNFEVRGDDFIKAVHSLQQNLESEGH

SEQ ID NO: 236 - protein, 231 aa, Lactobacillus rhamnosus
MIVKPKILVIEDDPDLNESIVDFIRDFSQPEAALTGADGLYLAEEGIFDAIVLDIMLPELNGFDLLKQLRAKQVKTPVLILTAKDALTDKVRGFELGGDDYLTKPFHREELIMRLKALLKRTGHFFDEDGLTAGPFEVHLNRHEVLIHDKPVALNGKEFDLLVYLLQNQKTIITKDQIFDRLWGFDSDTAVSVVEVYMSNLRKKLKPMQADVWIKTIRNVGYIFQEPEDRA

SEQ ID NO: 237 - protein, 317 aa, Lactobacillus rhamnosus
MLKLGVIGTGWITKQFVDAAAATKAYTLTAVYSRHQESAQTFIDQTAPATAYTKMDDFLGSDVDVVYIASPNSLHASQALAALDAGKHVIVEKPLVATAMEFEKLDEALRKKPSLYLFEAARHVYEHNFQVVDQFTHHHPIDGATLTYMKYSSKYDAFLAGKLPNVFNPEFAGGALMDLGIYLVYDAVAWFGVPDNAVYLPHFLKSGVDGDGVARLDYDQFAVTLITGKTTNSFLPSEIYSGKQTLTMDNAAELETIKLDDQVLSTEKLANPMEAEAAYFAKAITGHDRNAFDKAWQLAKEVHQVMSILRTSANLDF

SEQ ID NO: 238 - protein, 474 aa, Lactobacillus rhamnosus
MRKQLPKDFVIGGATAAYQVEGATKEDGKGRVLWDDFLEKQGRFSPDPAADFYHRYDEDLALAEAYGHQVIRLSIAWSRIFSDGAGAVESRGVAFYHRLFAACAKHHLIPFVTLHHFDTPERLHEIGDWLSQEMLEDFVEYARFCFEEFPEIKHWITINEPTSMAVQQYTSGTFPPAETGHFDKTFQAEHNQIVAHARIVNLYKSMGLDGEIGIVHALQTPYPYSDSSEDQHAADLQDALENRLYLDGTLAGDYAPKTLALIKEILAANQQPMFKYTDEEMAAIKKAAHQLDFVGVNNYFSKWLRAYHGKSETIHNGDGSKGSSVARLHGIGEEKKPAGIETTDWDWSIYPRGMYDMLMRIHQDYPLVPAIYVTENGIGLKESLPAEVTPNTVIADPKRIDYLKKYLSAIADAIQAGANVKGYFVWSLQDQFSWTNGYSKRYGLFFVDFPTQKRYVKQSAEWLKQVSQTHVIPE

SEQ ID NO: 239 - protein, 274 aa, Lactobacillus rhamnosus
MKNRLDDITDLMALGPTPDARDIQRRQTAHRIAIADAWQIQPGENILEIGCGQGDLSAVLADQVGPSGHVTGIDIASRDYGAPLTLGQAWDHLLNGPLASRLTVHFDTNLAASLGPVANQHFDRIVMAHSLWYFASANAFALLLKNLRTIGDYVDLAEWSLHPTALNQIGHLQAAMIQGLLYAIAPSDVANIRTLITPDTLAQIAHDNTWSYTAGKLIECPDLDDAKWEIATTKALLTELKLSTDLRDRVKPQLEAMQHNGTASLPTFTGRITF

SEQ ID NO: 240 - protein, 283 aa, Lactobacillus rhamnosus
MSPTLTDWQTAINHTLDEQLATVVNPHLRAAMAYSVDAGGKRLRPLLLLSVVAMYDGVVAEALPAAAALEFVHTYSLIHDDLPAMDNDDLRRGQPTNHKQFGEALAILAGDALLTDAFAILSQHYPGKGAELVQILAEAAGSSGMVAGQVLDMDGEQTQYDLATLKQMHQAKTGALIQAGVAMGSLFVAIPEADQAALADFAAAFGLGFQIKDDINDVTKTTAELGKTADKDVAEHKNTFPELLGLAGAKQALATQFQLATAALNSLTVDAADLKSILAVLQA

SEQ ID NO: 241 - protein, 292 aa, Lactobacillus rhamnosus
MELIEKAPAKINLSLDALYRHADGEHEWQMVMTSVDLADYVSIKPSHSIQVSTDSGFLPEDPRNLAYKAALALQRHANIRQGARIHIEKHIPVAAGLGGGSSDAAAVLRGLNSLLQLGYSRSQLARIGLQVDSDVPYCVYSETALVTGRGDVVTPLGSLPNFWVVLAKPRVSVSTPSILNAIDYQAGLLHPNTPEVVSGIQNHDFAQMISGMGNSLEAITASRYPEMTALKQRLKKYGAEIAQMSGSGPTVFGLCQKHSRAMRVYNSMKGFCREVYLLRPFCLSTNSHRLRG

SEQ ID NO: 242 - protein, 276 aa, Lactobacillus rhamnosus
MKFWKRAIITLALVLPVFVLAACGKSSSSSSKNETVKVGIMSTDKEIWTDIQSRLKKQGVTIKLVQFTDYNQPNQALEDGDIQLNAFQHHNFLNNWNKKHNTKIADIGDTYIGPMRAYSNKIKSLKEVKQGDQISLPNDPSNEGRALQLLAQNKLITLKKGVASPTIRDITSNKINLKFTELDAAQTARSLNDVAVAVVNNDIAAAANLKPSNAIAVEKITSQSKPWVNFIAAKSSKDKNNATYKKIVKAYQTKRTAELLKKVYKGSTLPAWNYKF

SEQ ID NO: 243 - protein, 406 aa, Lactobacillus rhamnosus
VGQIILAGAMQQLPVNMLGGFAVILTMGWLLGTIGANIPVVKNFGGPAILSLLVPSILVFYNALNPNVLKATDMLMKQANFLYFYIACLVCGSILGMNRKILIQGLMRMIIPMMLGMILAMGVGTLVGVLLGLEWKHTLFFIVTPVLAGGIGEGILPLSLGYSTITGTTSGALVAQLIPATIIGNFFAIMCSGLLNRLGEKRPELSGAGTVVRLNGAEELADALKTIRGPLDLKMMGAGVFTACTLFIIGMLLQSVPGFPGPVLMIVAAAILKYVNVIPGETHRGAKQLYKFISSNFTFPLMAGLGLLYIPLKDVVGMLSWQYFIVVISVVLTVVSTGFFVARFLNINPVETAIVTACQSGMGGTGDVAILSTANRMNLMPFAQVATRLGGAITVITMTAILRMIF

SEQ ID NO: 244 - protein, 412 aa, Lactobacillus rhamnosus
MNGGMTLQRVVVTGMGTVNPLGHSVAETVATMDAGKVGIQPITKFDAEKTGITVAGEVKDFKPEERMSKRLSKRMDLFTQYGLYSAIEAYEQSGLTEDAVDSDRVGVIFGSGIGGLTTIQEQVTKMYVKGPDRVSPLFVPEAISNMVAGTISHYFGTHGPSYVVVTACASATNAIGEAAMRIQTGKADVVITGGAEASVNEIGIAGFAALSALSKNTDPTKASLPFAADRNGFVLGEGGGALILESLEHAQKRGAKILGEVVGYGATSDAYHMTAPDPSGSQAARAMQLAVEEAGIKPSEVGYINAHGTATKANDAMESKAIHDLFGDDVLVSSTKALTGHLLGAAGAIEAIMTLSALQSGRLPMNVVDAAQDEDCPVTLVNRDNRDTSVDYALSNSFGFGGHNAVLAFKRW

SEQ ID NO: 245 - protein, 257 aa, Lactobacillus rhamnosus
MPKKETSAYATVQAARAPRPYTTRELINGLVTNFHELHGDRSSHDDPAVIGGIGWLDDQAATVIATDKGNDLTERLQTHFGSPEPWGYRKALRLMKQAAKFHRPIVTLINTPGAYPGKEAEANGQGAAIADLLVTCADLPTPILAVLVGEGGSGGALALAFGDEVWMTDKSMYSILSPEGFAAILWKDSSRAKEAAEVMQLTPRDLLAKKVCDRIITDTGTDFPSALKAEVKPKLATLMALDPQTLVTQRQARFRNF

SEQ ID NO: 246 - protein, 151 aa, Lactobacillus rhamnosus
VSVMDTKMIEVLIKQLEQSSLHELELTLGNDSLHLVKASPAAAPAPVTPAPENTAATPVTPVPDKPQADEGTAVKAPLVGIVYLAPKPGADPYFQVGDHVKKGDVVCIIESMKMMNEIKSTVSGTVKAVKVDNESLVEYDQPLLIVQEDKA

SEQ ID NO: 247 - protein, 449 aa, Lactobacillus rhamnosus
VFKKVLVANRGEIAVRIIQTLREMGITSVAVFSNADRHSLHVLLADEAICIGGPRATDSYLNMRNVVSAAILSGAEAVHPGFGFLSENAEFAKLVTDAGLAFIGPKPTAIEQMGDKAVARQTMIDIGVPVIPGSRPLQDVDTALAAAQAIGYPLMLKASAGGGGKGIRKLASADDLTAEFAGAQAEAQAAFGDPTMYLEKVIVPAKHVEVQVLRDQQGHVSVFPERDCSLQRHSQKMIEESPCPVLTSPERAKLLHLAETIADGVDYLNAGTIEFLMDQQHHFYFMEMNTRIQVEHPITEMVTGVDLVQAQLRIAAGEDVELTTPEPSGVAIECRLNAEDPDHQFMPDVGTLEQLRFPTGGLGLRVDTGVAPGDKISPYYDAMIAKIIVHGQTRQSALAKMHRALTELDVQGVKTNRDFALALFQAPKVLAGEADTAYLNRDFLPTMAG

SEQ ID NO: 248 - protein, 271 aa, Lactobacillus rhamnosus
MFQPQLTQEALAREAALPENLWIQCPYCKQGSYRESLGDAQVCPHCHYGFRITAKKRLALVATDATEWDADLTTTDPLDFPGYEKKLAAGRQASGLKDSVWTGQAKIGGQVCGLGIMDPKFMMGSLGTVTGERTTRLFEKATEANLPVVLYCASGGARMQEGIHSLMQMAKVSAAVKNHSNAGLLFISVLTDPTMGGVTASFAMQGDITLAEPHSLIGFAGRRVIEQTINQKLPQNFQRAETVLQSGFIDAIVKRSEQADYIGELLQMHRA

SEQ ID NO: 249 - protein, 307 aa, Lactobacillus rhamnosus
LQFAYVFNGQGAEVPGMGIDFYQNTLIFKEIIDRADAVLDFDLPEFLANGDFAAHPDYLQPALVAYSVAMHEVASAELPPEAALAGLSLGEYSALIAGGGLSLESGLELVAARGKAMAAACQEQPGGMLAVMSGDETIIKTACQQAEHVWPANYNGPKQTVLAGTHDDLATVEKWLTDQGVRAIPLQVAGGFHSPLMASAQPPLQAALAAAHVFEPVIPVISTTALKPFSASNIRPVLAAQVAEPTKFAAVIAQLKAQGVDTIVELGPKPVLSKMIKRIDRKMTTYLIRDAASLNEVADLNNGVKAD

SEQ ID NO: 250 - protein, 181 aa, Lactobacillus rhamnosus
VDDPTTGDQLVAAALDQFGSVDVLVNNAGITDDMLAMRMKPASFAKVVQVNLDGTFYVTQPAFKKMLKARAGVIINLASVVGLTGNIGQANYAASKAGIIGLTKTLAREGAMRGVRVNAIAPGMIATDMTAALSQSSQDQILAEIPLKRFGQPEEIAHTARFLVENAYITGQTVTVAGGLG

SEQ ID NO: 251 - protein, 326 aa, Lactobacillus rhamnosus
MSPLMERLGVKYPLFQGGMAWVADGKLAASVSEAGGLGIIGSGHAPASWVKEQIEVAKSMTDKAFGVNVMLLSPFVEQVIDVIVDAKVALVTTGAGDPSRYLERLQQNGTVVMPVVPSVAMAKRMARDGVDGVIAEGMESGGHIGSITTMALVPQVVDAVDIPVVAAGGIGDGRGVAAALSLGAVGVQMGTRFLTSTSSRIHQNYKDAVIKAKDVDTLVTGMYVGHAARVLKNPMSRNYLKLEKEIALSGTTDFTAVEELGNGSLRKAVLEGDRDHGSFMAGEIAGLVKREESSKDIVEEVMQQAKEIVAGSKMAALLTSQVDVQA

SEQ ID NO: 252 - protein, 340 aa, Lactobacillus rhamnosus
MTVKIGINGFGRIGRLAFRRIYELGAKSNDIQVVAINDLTSPTMLAHLLKYDSTHGTFPGEVSATDNGIVVDGKEYRVYAEPQAQNIPWVKNDGVDYVLECTGFYTSAEKSQAHLDAGAKRVLISAPAGKIKTIVYNVNDDTLNADDKIVSAGSCTTNCLAPMAYFLNQEFGIEVGTMTTVHAYTSTQMLLDGPVRGGNLRAARSAAANTIPHSTGAAKAIGLVIPELNGKLQGHAQRVSVVDGSLTELVSILKTKNVTADQVNEAIKKHTENNPSFGWNEDEIVSSDVIGTTYGSIFDPTQTEVTTAGDYQLVKTVAWYDNEYGFTCQMIRTLLKFATL

SEQ ID NO: 253 - protein, 176 aa, Lactobacillus rhamnosus
VSRIGYKVIKVPAGVTVTKDGDNITVKGPKGELTRHFAPEIELHQEGDEINFTRPDDSYKAIHGTMRANLNNMVVGVTEGYKKEMKLVGVGYRAQKQGEKLVLNVGNSHPVEMPAPKGVTVEVPSTTQIIISGISKQVVGQFAAVVRSVRAPEPYKGKGIRYVDEHVRRKEGKTGK

We claim:

1. An isolated polypeptide comprising SEQ ID NO: 218.

2. An isolated polynucleotide comprising an amino acid sequence selected from the group consisting of:
   (a) sequences having at least 75% identity to SEQ ID NO: 218;
   (b) sequences having at least 90% identity to SEQ ID NO: 218; and
   (c) sequences having at least 95% identity to SEQ ID NO: 218,
wherein the polypeptide has undecaprenyl-phosphate glycosyl-1-phosphate transferase activity.

3. A fusion protein comprising at least one polypeptide according to claim 1.

4. An isolated polypeptide encoded by a polynucleotide of SEQ ID NO: 93.

5. A composition comprising a polypeptide according to claim 1 and at least one component selected from the group consisting of:
physiologically acceptable carriers and immunostimulants.

6. A method for modifying at least one property of a product, food, food additive, nutritional supplement or probiotic supplement, wherein the product, food, food additive, nutritional supplement or probiotic supplement is prepared from milk and the property is selected from the group consisting of: flavor; aroma; texture; nutritional benefits; immune system modulating properties; and health benefits, the method comprising adding a polypeptide of claim 1 to the milk.

7. A food product comprising an isolated polypeptide of claim 1.

8. The food product of claim 7, wherein the food product is derived from milk.

9. A fusion protein comprising at least one polypeptide according to claim 2.

10. A composition comprising a polypeptide according to claim 2 and at least one component selected from the group consisting of: physiologically acceptable carriers and immunostimulants.

11. A food product comprising an isolated polypeptide of claim 2.

12. The food product of claim 11, wherein the food product is derived from milk.

* * * * *